US010150996B2

(12) United States Patent
Robins et al.

(10) Patent No.: US 10,150,996 B2
(45) Date of Patent: Dec. 11, 2018

(54) QUANTIFICATION OF ADAPTIVE IMMUNE CELL GENOMES IN A COMPLEX MIXTURE OF CELLS

(71) Applicants: Adaptive Biotechnologies Corporation, Seattle, WA (US); FRED HUTCHINSON CANCER RESEARCH CENTER, Seattle, WA (US)

(72) Inventors: Harlan Saul Robins, Seattle, WA (US); Christopher Scott Carlson, Kirkland, WA (US); Mark J. Rieder, Seattle, WA (US); Anna M. Sherwood, Seattle, WA (US); Ryan O. Emerson, Seattle, WA (US)

(73) Assignee: ADAPTIVE BIOTECHNOLOGIES CORP., Seattle, WA (US)

(*) Notice: Subject to any disclaimer, the term of this patent is extended or adjusted under 35 U.S.C. 154(b) by 61 days.

(21) Appl. No.: 15/304,631

(22) PCT Filed: Mar. 5, 2015

(86) PCT No.: PCT/US2015/018967
§ 371 (c)(1),
(2) Date: Oct. 17, 2016

(87) PCT Pub. No.: WO2015/160439
PCT Pub. Date: Oct. 22, 2015

(65) Prior Publication Data
US 2017/0037469 A1  Feb. 9, 2017

Related U.S. Application Data

(60) Provisional application No. 61/981,085, filed on Apr. 17, 2014, provisional application No. 61/983,920, filed on Apr. 24, 2014.

(51) Int. Cl.
C12Q 1/68 (2018.01)
C12Q 1/6881 (2018.01)

(52) U.S. Cl.
CPC ..... *C12Q 1/6881* (2013.01); *C12Q 2600/156* (2013.01); *C12Q 2600/16* (2013.01)

(58) Field of Classification Search
CPC .................................................. C12Q 1/6881
See application file for complete search history.

(56) References Cited

U.S. PATENT DOCUMENTS

| | | | |
|---|---|---|---|
| 3,270,960 A | 9/1966 | Phillips | |
| 3,773,919 A | 11/1973 | Boswell et al. | |
| 4,474,754 A | 10/1984 | Shimizu et al. | |
| 4,683,195 A | 7/1987 | Mullis et al. | |
| 4,683,202 A | 7/1987 | Mullis | |
| 4,751,188 A | 6/1988 | Valet | |
| 4,800,159 A | 1/1989 | Mullis et al. | |
| 4,876,189 A | 10/1989 | Schetters | |
| 4,942,124 A | 7/1990 | Church | |
| 4,965,188 A | 10/1990 | Mullis et al. | |
| 5,075,217 A | 12/1991 | Weber | |
| 5,126,022 A | 6/1992 | Soane et al. | |
| 5,149,625 A | 9/1992 | Church et al. | |
| 5,168,038 A | 12/1992 | Tecott et al. | |
| 5,189,147 A | 2/1993 | Saito et al. | |
| 5,210,015 A | 5/1993 | Gelfand et al. | |
| 5,213,960 A | 5/1993 | Chang | |
| 5,231,012 A | 7/1993 | Mosmann et al. | |
| 5,296,351 A | 3/1994 | Morley | |
| 5,298,396 A | 3/1994 | Kotzin et al. | |
| 5,326,696 A | 7/1994 | Chang | |
| 5,336,598 A | 8/1994 | Kotzin et al. | |
| 5,364,759 A | 11/1994 | Caskey et al. | |
| 5,399,491 A | 3/1995 | Kacian et al. | |
| 5,418,134 A | 5/1995 | Morley | |
| 5,449,752 A | 9/1995 | Fujii et al. | |
| 5,498,392 A | 3/1996 | Wilding et al. | |
| 5,506,126 A | 4/1996 | Seed et al. | |
| 5,587,128 A | 12/1996 | Wilding et al. | |
| 5,627,037 A | 5/1997 | Ward | |
| 5,627,052 A | 5/1997 | Schrader | |
| 5,635,354 A | 6/1997 | Kourilsky et al. | |

(Continued)

FOREIGN PATENT DOCUMENTS

| CN | 101225441 A | 7/2008 |
|---|---|---|
| CN | 102272327 A | 12/2011 |

(Continued)

OTHER PUBLICATIONS

US 8,642,750, 02/2014, Faham et al. (withdrawn)
Lorimer, I. A., and Pastan, Ira. "Random recombination of antibody single chain Fv sequences after fragmentation with DNaseI in the presence of Mn2+." Nucleic Acids Research (1995); 23.15: 3067-3068.
Ohlin, Mats, et al. "Light chain shuffling of a high affinity antibody results in a drift in epitope recognition." Molecular Immunology (1996); 33.1: 47-56.
PCT/US2015/058035, International Preliminary Report on Patentability dated May 2, 2017, 8 pages.
Tam, James P. "Synthetic peptide vaccine design: synthesis and properties of a high-density multiple antigenic peptide system." Proceedings of the National Academy of Sciences (1988); 85.15: 5409-5413.

(Continued)

*Primary Examiner* — David C Thomas
(74) *Attorney, Agent, or Firm* — Cooley LLP

(57) ABSTRACT

A relative representation of adaptive immune cells in a biological sample is quantified using multiplex PCR and sequencing of adaptive immune cells, control genes, and synthetic template molecules. Disclosed herein are methods for quantifying a number of adaptive immune cells in a biological sample, and methods for quantifying a relative representation of adaptive immune cells in a biological sample that comprises a mixture of cells comprising adaptive immune cells and cells that are not adaptive immune cells. Methods are provided for amplifying by multiplex PCR and sequencing a first set of synthetic templates each comprising one TCR or IgV segment and one TCR of Ig J or C segment and a unique bar code.

20 Claims, 6 Drawing Sheets

Specification includes a Sequence Listing.

(56) References Cited

U.S. PATENT DOCUMENTS

| | | |
|---|---|---|
| 5,635,400 A | 6/1997 | Brenner |
| 5,667,967 A | 9/1997 | Steinman et al. |
| 5,698,396 A | 12/1997 | Pfreundschuh |
| 5,699,798 A | 12/1997 | Hochman et al. |
| 5,741,676 A | 4/1998 | Fuller |
| 5,776,708 A | 7/1998 | Kotzin et al. |
| 5,776,737 A | 7/1998 | Dunn |
| 5,837,447 A | 11/1998 | Gorski |
| 5,846,719 A | 12/1998 | Brenner et al. |
| 5,854,033 A | 12/1998 | Lizardi |
| 5,858,195 A | 1/1999 | Ramsey |
| 5,925,517 A | 7/1999 | Tyagi et al. |
| 5,935,793 A | 8/1999 | Wong |
| 5,969,108 A | 10/1999 | McCafferty et al. |
| 5,981,176 A | 11/1999 | Wallace |
| 5,981,179 A | 11/1999 | Lorinez et al. |
| 6,001,229 A | 12/1999 | Ramsey |
| 6,010,607 A | 1/2000 | Ramsey |
| 6,033,546 A | 3/2000 | Ramsey |
| 6,054,034 A | 4/2000 | Soane et al. |
| 6,087,096 A | 7/2000 | Dau et al. |
| 6,090,592 A | 7/2000 | Adams et al. |
| 6,091,000 A | 7/2000 | Haynes |
| 6,143,496 A | 11/2000 | Brown et al. |
| 6,172,214 B1 | 1/2001 | Brenner |
| 6,174,670 B1 | 1/2001 | Wittwer et al. |
| 6,228,589 B1 | 5/2001 | Brenner |
| 6,258,540 B1 | 7/2001 | Lo et al. |
| 6,258,568 B1 | 7/2001 | Nyren |
| 6,291,183 B1 | 9/2001 | Pirrung et al. |
| 6,300,070 B1 | 10/2001 | Boles et al. |
| 6,312,690 B1 | 11/2001 | Edelman et al. |
| 6,416,948 B1 | 7/2002 | Pilarski et al. |
| 6,440,706 B1 | 8/2002 | Vogelstein et al. |
| 6,458,530 B1 | 10/2002 | Morris et al. |
| 6,489,103 B1 | 12/2002 | Griffiths et al. |
| 6,524,829 B1 | 2/2003 | Seegar |
| 6,569,627 B2 | 5/2003 | Wittwer et al. |
| 6,596,492 B2 | 7/2003 | Avery et al. |
| 6,605,272 B2 | 8/2003 | Novak et al. |
| 6,613,525 B2 | 9/2003 | Nelson et al. |
| 6,667,159 B1 | 12/2003 | Walt |
| 6,753,147 B2 | 6/2004 | Vogelstein et al. |
| 6,787,308 B2 | 9/2004 | Balasubramanian et al. |
| 6,794,499 B2 | 9/2004 | Wengel et al. |
| 6,806,079 B1 | 10/2004 | McCafferty et al. |
| 6,858,412 B2 | 2/2005 | Willis et al. |
| 6,919,434 B1 | 7/2005 | Goto et al. |
| 6,964,850 B2 | 11/2005 | Bevilacqua |
| 7,068,874 B2 | 6/2006 | Wang et al. |
| 7,112,423 B2 | 9/2006 | Van Ness et al. |
| 7,115,400 B1 | 10/2006 | Adessi et al. |
| 7,148,040 B2 | 12/2006 | Meagher et al. |
| 7,157,228 B2 | 1/2007 | Hashmi et al. |
| 7,157,274 B2 | 1/2007 | Bohm et al. |
| 7,208,795 B2 | 4/2007 | Carver et al. |
| 7,232,653 B1 | 6/2007 | Austrup et al. |
| 7,306,906 B2 | 12/2007 | Maruyama et al. |
| 7,313,308 B2 | 12/2007 | Turner et al. |
| 7,323,305 B2 | 1/2008 | Leamon et al. |
| 7,323,306 B2 | 1/2008 | Dunn et al. |
| 7,329,731 B2 | 2/2008 | Jakobsen et al. |
| 7,351,578 B2 | 4/2008 | Cheo et al. |
| 7,365,179 B2 | 4/2008 | Brenner |
| 7,371,519 B2 | 5/2008 | Wolber |
| 7,375,211 B2 | 5/2008 | Kou |
| 7,393,665 B2 | 7/2008 | Brenner |
| 7,432,084 B2 | 10/2008 | Shoemaker |
| 7,537,897 B2 | 5/2009 | Brenner et al. |
| 7,544,473 B2 | 6/2009 | Brenner |
| 7,572,582 B2 | 8/2009 | Wengel et al. |
| 7,662,557 B2 | 2/2010 | McCafferty et al. |
| 7,666,604 B2 | 2/2010 | Jakobsen et al. |
| 7,691,994 B2 | 4/2010 | Brewer et al. |
| 7,700,323 B2 | 4/2010 | Willis et al. |
| 7,709,197 B2 | 5/2010 | Drmanac |
| 7,741,463 B2 | 6/2010 | Gormley et al. |
| 7,749,697 B2 | 7/2010 | Oleksiewicz et al. |
| 7,785,783 B2 | 8/2010 | Morley et al. |
| 7,833,716 B2 | 11/2010 | Becker et al. |
| 7,842,457 B2 | 11/2010 | Berka et al. |
| 7,862,999 B2 | 1/2011 | Zheng et al. |
| 7,879,324 B2 | 2/2011 | Saxon |
| 7,892,550 B2 | 2/2011 | Dennis et al. |
| 7,907,800 B2 | 3/2011 | Foquet et al. |
| 7,915,015 B2 | 3/2011 | Vogelstein et al. |
| 7,955,794 B2 | 6/2011 | Shen et al. |
| 7,956,043 B2 | 6/2011 | Krieg et al. |
| 7,960,116 B2 | 6/2011 | Eid et al. |
| 8,012,690 B2 | 9/2011 | Berka et al. |
| 8,021,842 B2 | 9/2011 | Brenner |
| 8,030,023 B2 | 10/2011 | Adams et al. |
| 8,048,627 B2 | 11/2011 | Dressman et al. |
| 8,053,188 B2 | 11/2011 | Gullberg et al. |
| 8,053,235 B2 | 11/2011 | Buckner et al. |
| 8,137,569 B2 | 3/2012 | Harnack et al. |
| 8,137,936 B2 | 3/2012 | MacEvicz |
| 8,153,375 B2 | 4/2012 | Travers et al. |
| 8,158,359 B2 | 4/2012 | Leamon et al. |
| 8,236,503 B2 | 8/2012 | Faham et al. |
| 8,283,294 B2 | 10/2012 | Kastrup et al. |
| 8,309,312 B2 | 11/2012 | Lang et al. |
| 8,313,625 B2 | 11/2012 | Rothberg et al. |
| 8,318,433 B2 | 11/2012 | Brenner |
| 8,394,590 B2 | 3/2013 | Kwong et al. |
| 8,445,205 B2 | 5/2013 | Brenner |
| 8,481,292 B2 | 7/2013 | Casbon et al. |
| 8,507,205 B2 | 8/2013 | Faham |
| 8,628,927 B2 | 1/2014 | Faham |
| 8,685,678 B2 | 4/2014 | Casbon |
| 8,685,898 B2 | 4/2014 | Wiley |
| 8,691,510 B2 | 4/2014 | Faham |
| 8,699,361 B2 | 4/2014 | Jim et al. |
| 8,715,967 B2 | 5/2014 | Casbon |
| 8,722,368 B2 | 5/2014 | Casbon |
| 8,728,766 B2 | 5/2014 | Casbon |
| 8,741,606 B2 | 6/2014 | Casbon |
| 8,748,103 B2 | 6/2014 | Faham |
| 8,759,036 B2 | 6/2014 | Wang |
| 8,795,970 B2 | 8/2014 | Faham |
| 8,826,321 B2 | 9/2014 | Cronin et al. |
| 8,835,358 B2 | 9/2014 | Fodor |
| 9,012,148 B2 | 4/2015 | Han et al. |
| 9,043,160 B1 | 5/2015 | Moorhead et al. |
| 9,150,905 B2 | 10/2015 | Robins et al. |
| 9,217,176 B2 | 12/2015 | Faham et al. |
| 9,228,232 B2 | 1/2016 | Faham et al. |
| 9,290,811 B2 | 3/2016 | Quake et al. |
| 9,371,558 B2 | 6/2016 | Robins et al. |
| 9,394,567 B2 | 7/2016 | Asbury et al. |
| 9,416,420 B2 | 8/2016 | Faham et al. |
| 9,506,119 B2 | 11/2016 | Faham et al. |
| 9,512,487 B2 | 12/2016 | Faham et al. |
| 9,708,657 B2 | 7/2017 | Asbury et al. |
| 9,809,813 B2 | 11/2017 | Robins et al. |
| 2002/0076725 A1 | 6/2002 | Toyosaki-Maeda et al. |
| 2002/0110807 A1 | 8/2002 | Pilarski et al. |
| 2003/0096277 A1 | 5/2003 | Chen |
| 2003/0120061 A1 | 6/2003 | Zhang |
| 2003/0162197 A1 | 8/2003 | Morley et al. |
| 2003/0207300 A1 | 11/2003 | Matray et al. |
| 2004/0018489 A1 | 1/2004 | Ma et al. |
| 2004/0033490 A1 | 2/2004 | Laird et al. |
| 2004/0121364 A1 | 6/2004 | Chee et al. |
| 2004/0132050 A1 | 7/2004 | Monforte |
| 2004/0146901 A1 | 7/2004 | Morris et al. |
| 2004/0170977 A1 | 9/2004 | Laird |
| 2004/0235061 A1 | 11/2004 | Wilkie et al. |
| 2004/0248172 A1 | 12/2004 | Samoszuk et al. |
| 2005/0037356 A1 | 2/2005 | Gullberg et al. |
| 2005/0064421 A1 | 3/2005 | Gehrmann et al. |
| 2005/0142577 A1 | 6/2005 | Jones et al. |
| 2005/0250147 A1 | 11/2005 | MacEvicz |
| 2005/0255482 A1 | 11/2005 | Morley et al. |

(56) References Cited

U.S. PATENT DOCUMENTS

| | | |
|---|---|---|
| 2005/0260570 A1 | 11/2005 | Mao et al. |
| 2006/0019304 A1 | 1/2006 | Hardenbol et al. |
| 2006/0020397 A1 | 1/2006 | Kermani |
| 2006/0046258 A1 | 3/2006 | Lapidus et al. |
| 2006/0085139 A1 | 4/2006 | Collette et al. |
| 2006/0088876 A1 | 4/2006 | Bauer |
| 2006/0134125 A1 | 6/2006 | Luxembourg et al. |
| 2006/0147925 A1 | 7/2006 | Morley et al. |
| 2006/0199210 A1 | 9/2006 | Weichselbaum et al. |
| 2006/0211030 A1 | 9/2006 | Brenner |
| 2006/0216737 A1 | 9/2006 | Bodeau |
| 2006/0228350 A1 | 10/2006 | Wu et al. |
| 2006/0233812 A1 | 10/2006 | Burnie et al. |
| 2006/0234234 A1 | 10/2006 | Van Dongen et al. |
| 2006/0259248 A1 | 11/2006 | Collette et al. |
| 2006/0263789 A1 | 11/2006 | Kincaid |
| 2007/0020640 A1 | 1/2007 | McCloskey et al. |
| 2007/0020670 A1 | 1/2007 | Loken et al. |
| 2007/0105105 A1 | 5/2007 | Clelland et al. |
| 2007/0117134 A1 | 5/2007 | Kou |
| 2007/0160994 A1 | 7/2007 | Lim et al. |
| 2007/0161001 A1 | 7/2007 | Leshkowitz |
| 2007/0172873 A1 | 7/2007 | Brenner et al. |
| 2007/0238099 A1 | 10/2007 | Cohen et al. |
| 2007/0243564 A1 | 10/2007 | Lawson et al. |
| 2007/0264653 A1 | 11/2007 | Berlin et al. |
| 2007/0286849 A1 | 12/2007 | Chaturvedi |
| 2008/0050780 A1 | 2/2008 | Lee et al. |
| 2008/0069770 A1 | 3/2008 | Hercend et al. |
| 2008/0108509 A1 | 5/2008 | Haupl et al. |
| 2008/0166704 A1 | 7/2008 | Marche et al. |
| 2008/0166718 A1 | 7/2008 | Lim et al. |
| 2008/0199916 A1 | 8/2008 | Zheng et al. |
| 2008/0248484 A1 | 10/2008 | Bauer |
| 2008/0274904 A1 | 11/2008 | Gormley et al. |
| 2008/0280774 A1 | 11/2008 | Burczynski et al. |
| 2008/0286777 A1 | 11/2008 | Candeias et al. |
| 2009/0026082 A1 | 1/2009 | Rothberg et al. |
| 2009/0053184 A1 | 2/2009 | Morgan et al. |
| 2009/0098555 A1 | 4/2009 | Roth et al. |
| 2009/0105959 A1 | 4/2009 | Braverman et al. |
| 2009/0181859 A1 | 7/2009 | Muraguchi |
| 2009/0197257 A1 | 8/2009 | Harris |
| 2009/0208955 A1 | 8/2009 | Robins et al. |
| 2009/0226975 A1 | 9/2009 | Sabot et al. |
| 2009/0233301 A1 | 9/2009 | Lee |
| 2009/0233802 A1 | 9/2009 | Bignell et al. |
| 2009/0253581 A1 | 10/2009 | Van Eijk et al. |
| 2009/0264299 A1 | 10/2009 | Drmanac et al. |
| 2009/0280489 A1 | 11/2009 | Devinder et al. |
| 2009/0286237 A1 | 11/2009 | Fitzgerald et al. |
| 2009/0298060 A1 | 12/2009 | Lal et al. |
| 2010/0008920 A1 | 1/2010 | Schneck et al. |
| 2010/0021894 A1 | 1/2010 | Mirkin et al. |
| 2010/0021896 A1 | 1/2010 | Han |
| 2010/0021984 A1 | 1/2010 | Edd |
| 2010/0027896 A1 | 2/2010 | Geva et al. |
| 2010/0034834 A1 | 2/2010 | Robbins et al. |
| 2010/0035764 A1 | 2/2010 | Chen |
| 2010/0040606 A1 | 2/2010 | Lantto et al. |
| 2010/0042329 A1 | 2/2010 | Hood et al. |
| 2010/0105886 A1 | 4/2010 | Wondenberg |
| 2010/0129874 A1 | 5/2010 | Mitra et al. |
| 2010/0137143 A1 | 6/2010 | Rothberg et al. |
| 2010/0151471 A1 | 6/2010 | Faham et al. |
| 2010/0159456 A1 | 6/2010 | Albitar |
| 2010/0167353 A1 | 7/2010 | Walder et al. |
| 2010/0173394 A1 | 7/2010 | Colston, Jr. |
| 2010/0255471 A1 | 10/2010 | Clarke |
| 2010/0261204 A1 | 10/2010 | Goolsby et al. |
| 2010/0267043 A1 | 10/2010 | Braverman |
| 2010/0285975 A1 | 11/2010 | Mathies |
| 2010/0300895 A1 | 12/2010 | Nobile et al. |
| 2010/0304982 A1 | 12/2010 | Hinz et al. |
| 2010/0323348 A1 | 12/2010 | Hamady et al. |
| 2010/0323355 A1 | 12/2010 | Dittmer |
| 2010/0330571 A1 | 12/2010 | Robins et al. |
| 2011/0003291 A1 | 1/2011 | Pasqual et al. |
| 2011/0014659 A1 | 1/2011 | Balazs et al. |
| 2011/0097712 A1 | 4/2011 | Cantor et al. |
| 2011/0104671 A1 | 5/2011 | Dornan et al. |
| 2011/0105343 A1 | 5/2011 | Puledran et al. |
| 2011/0129830 A1 | 6/2011 | Ladner et al. |
| 2011/0160078 A1 | 6/2011 | Fodor et al. |
| 2011/0166034 A1 | 7/2011 | Kwong et al. |
| 2011/0183863 A1 | 7/2011 | Wagner et al. |
| 2011/0195253 A1 | 8/2011 | Hinz et al. |
| 2011/0207134 A1 | 8/2011 | Faham et al. |
| 2011/0207135 A1 | 8/2011 | Faham et al. |
| 2011/0207617 A1 | 8/2011 | Faham et al. |
| 2011/0251099 A1 | 10/2011 | Visvanathan et al. |
| 2012/0010096 A1 | 1/2012 | Wohlgemuth et al. |
| 2012/0035062 A1 | 2/2012 | Schultz et al. |
| 2012/0058902 A1 | 3/2012 | Livingston et al. |
| 2012/0071331 A1 | 3/2012 | Casbon et al. |
| 2012/0073667 A1 | 3/2012 | Schultz et al. |
| 2012/0122714 A1 | 5/2012 | Samuels |
| 2012/0135409 A1 | 5/2012 | Faham |
| 2012/0143531 A1 | 6/2012 | Davey et al. |
| 2012/0172241 A1 | 7/2012 | Rearick et al. |
| 2012/0173158 A1 | 7/2012 | Hubbell |
| 2012/0220466 A1 | 8/2012 | Fire et al. |
| 2012/0308999 A1 | 12/2012 | Sarma et al. |
| 2013/0005584 A1 | 1/2013 | Faham |
| 2013/0017957 A1 | 1/2013 | Faham et al. |
| 2013/0045221 A1 | 2/2013 | Stauss et al. |
| 2013/0065768 A1 | 3/2013 | Zheng |
| 2013/0116130 A1 | 5/2013 | Fu |
| 2013/0123120 A1 | 5/2013 | Zimmermann et al. |
| 2013/0136799 A1 | 5/2013 | Faham et al. |
| 2013/0137108 A1 | 5/2013 | Tripathi et al. |
| 2013/0150252 A1 | 6/2013 | Faham |
| 2013/0196328 A1 | 8/2013 | Pepin |
| 2013/0196861 A1 | 8/2013 | Quake |
| 2013/0202718 A1 | 8/2013 | Pepin |
| 2013/0236895 A1 | 9/2013 | Faham |
| 2013/0253842 A1 | 9/2013 | Sherwood et al. |
| 2013/0267427 A1 | 10/2013 | Faham |
| 2013/0273647 A1 | 10/2013 | Sahin et al. |
| 2013/0288237 A1 | 10/2013 | Robins et al. |
| 2013/0302801 A1 | 11/2013 | Asbury |
| 2013/0324422 A1 | 12/2013 | Faham et al. |
| 2013/0344066 A1 | 12/2013 | Faham |
| 2014/0057799 A1 | 2/2014 | Johnson et al. |
| 2014/0065629 A1 | 3/2014 | Barken et al. |
| 2014/0094376 A1 | 4/2014 | Han |
| 2014/0127699 A1 | 5/2014 | Han |
| 2014/0155277 A1 | 6/2014 | Wiley |
| 2014/0186848 A1 | 7/2014 | Robins et al. |
| 2014/0194295 A1 | 7/2014 | Robins et al. |
| 2014/0206548 A1 | 7/2014 | Robins et al. |
| 2014/0206549 A1 | 7/2014 | Robins et al. |
| 2014/0213463 A1 | 7/2014 | Robins et al. |
| 2014/0221220 A1 | 8/2014 | Robins et al. |
| 2014/0227705 A1 | 8/2014 | Vogelstein et al. |
| 2014/0234835 A1 | 8/2014 | Pepin |
| 2014/0235454 A1 | 8/2014 | Faham |
| 2014/0255929 A1 | 9/2014 | Zheng |
| 2014/0255944 A1 | 9/2014 | Carlton |
| 2014/0256567 A1 | 9/2014 | Robins et al. |
| 2014/0256592 A1 | 9/2014 | Faham |
| 2014/0315725 A1 | 10/2014 | Faham et al. |
| 2014/0322716 A1 | 10/2014 | Robins et al. |
| 2014/0336059 A1 | 11/2014 | Faham et al. |
| 2014/0342360 A1 | 11/2014 | Faham et al. |
| 2014/0342367 A1 | 11/2014 | Faham et al. |
| 2014/0349883 A1 | 11/2014 | Faham et al. |
| 2014/0356339 A1 | 12/2014 | Faham et al. |
| 2015/0017630 A1 | 1/2015 | Oved et al. |
| 2015/0017652 A1 | 1/2015 | Robins et al. |
| 2015/0031043 A1 | 1/2015 | Faham et al. |
| 2015/0031553 A1 | 1/2015 | Faham et al. |
| 2015/0031555 A1 | 1/2015 | Johnson et al. |
| 2015/0038346 A1 | 2/2015 | Faham et al. |

(56) References Cited

U.S. PATENT DOCUMENTS

| | | |
|---|---|---|
| 2015/0051089 A1 | 2/2015 | Robins et al. |
| 2015/0065352 A1 | 3/2015 | Faham et al. |
| 2015/0133317 A1 | 5/2015 | Robinson et al. |
| 2015/0167080 A1 | 6/2015 | Moorhead et al. |
| 2015/0203897 A1 | 7/2015 | Robins et al. |
| 2015/0215062 A1 | 7/2015 | Lee |
| 2015/0218656 A1 | 8/2015 | Kirsch et al. |
| 2015/0232936 A1 | 8/2015 | Shoemaker et al. |
| 2015/0247182 A1 | 9/2015 | Faham et al. |
| 2015/0247198 A1 | 9/2015 | Klinger et al. |
| 2015/0247201 A1 | 9/2015 | Faham et al. |
| 2015/0252419 A1 | 9/2015 | Moorhead et al. |
| 2015/0252422 A1 | 9/2015 | Faham et al. |
| 2015/0259734 A1 | 9/2015 | Asbury et al. |
| 2015/0275296 A1 | 10/2015 | Klinger et al. |
| 2015/0275308 A1 | 10/2015 | Carlton et al. |
| 2015/0299785 A1 | 10/2015 | Livingston et al. |
| 2015/0299786 A1 | 10/2015 | Robins et al. |
| 2015/0299800 A1 | 10/2015 | Faham et al. |
| 2016/0024493 A1 | 1/2016 | Robins et al. |
| 2016/0115532 A1 | 4/2016 | Faham |
| 2016/0138011 A1 | 5/2016 | Dewitt et al. |
| 2016/0186260 A1 | 6/2016 | Klinger et al. |
| 2016/0201133 A1 | 7/2016 | Faham et al. |
| 2016/0251721 A1 | 9/2016 | Robins et al. |
| 2016/0251728 A1 | 9/2016 | Faham et al. |
| 2016/0258025 A1 | 9/2016 | Klinger et al. |
| 2016/0304956 A1 | 10/2016 | Robins et al. |
| 2016/0319340 A1 | 11/2016 | Robins et al. |
| 2017/0292149 A1 | 10/2017 | Emerson et al. |
| 2017/0335386 A1 | 11/2017 | Livingston et al. |
| 2017/0335390 A1 | 11/2017 | Asbury et al. |
| 2017/0335391 A1 | 11/2017 | Emerson et al. |
| 2017/0349954 A1 | 12/2017 | Faham et al. |
| 2018/0037953 A1 | 2/2018 | Emerson et al. |
| 2018/0073015 A1 | 3/2018 | Robins et al. |
| 2018/0080090 A1 | 3/2018 | Faham et al. |
| 2018/0087109 A1 | 3/2018 | Klinger et al. |
| 2018/0112278 A1 | 4/2018 | Faham et al. |

FOREIGN PATENT DOCUMENTS

| | | |
|---|---|---|
| CN | 103097888 A | 5/2013 |
| EA | 007958 B1 | 2/2007 |
| EP | 0303459 A2 | 2/1989 |
| EP | 0799897 A1 | 10/1997 |
| EP | 1516929 A2 | 3/2005 |
| EP | 1544308 A1 | 6/2005 |
| EP | 1549764 B1 | 7/2005 |
| EP | 0972081 B1 | 6/2007 |
| EP | 1544308 B1 | 1/2009 |
| EP | 2062982 A1 | 5/2009 |
| EP | 2088432 A1 | 8/2009 |
| EP | 2418287 A2 | 2/2012 |
| EP | 2364368 B1 | 1/2014 |
| JP | 4262799 A | 9/1992 |
| JP | 2002-503954 A | 2/2001 |
| JP | 2005-245381 A | 9/2005 |
| JP | 2006-501842 A | 1/2006 |
| JP | 2007-515955 A | 6/2007 |
| JP | 2007-536939 A | 12/2007 |
| JP | 2008-099588 A | 5/2008 |
| JP | 2011-505123 A | 2/2011 |
| JP | 2012-508011 A | 4/2012 |
| JP | 2013-524848 A | 6/2013 |
| JP | 2013-524849 A | 6/2013 |
| WO | WO 1993/001838 A1 | 2/1993 |
| WO | WO 1995/028481 A1 | 10/1995 |
| WO | WO 1997/013868 A1 | 4/1997 |
| WO | WO 1997/013877 A1 | 4/1997 |
| WO | WO 1997/018330 A1 | 5/1997 |
| WO | WO 1997/046706 A1 | 12/1997 |
| WO | WO 1998/001738 A2 | 1/1998 |
| WO | WO 1998/044151 A1 | 10/1998 |
| WO | WO 1999/019717 A1 | 4/1999 |
| WO | WO 1999/020798 A1 | 4/1999 |
| WO | WO 2001/014424 A2 | 3/2001 |
| WO | WO 2002/024322 A2 | 3/2002 |
| WO | WO 2003/008624 A2 | 1/2003 |
| WO | WO 2003/044225 A2 | 5/2003 |
| WO | WO 2003/052101 A1 | 6/2003 |
| WO | WO 2003/059155 A2 | 7/2003 |
| WO | WO 2004/003820 A2 | 1/2004 |
| WO | WO 2004/033728 A2 | 4/2004 |
| WO | WO 2004/034031 A2 | 4/2004 |
| WO | WO 2004/044209 A1 | 5/2004 |
| WO | WO 2004/046098 A2 | 6/2004 |
| WO | WO 2004/063706 A2 | 7/2004 |
| WO | WO 2004/096985 A2 | 11/2004 |
| WO | WO 2005/003375 A2 | 1/2005 |
| WO | WO 2005/005651 A2 | 1/2005 |
| WO | WO 2005/010200 A2 | 2/2005 |
| WO | WO 2005/042774 A2 | 5/2005 |
| WO | WO 2005/053603 A2 | 6/2005 |
| WO | WO 2005/056828 A1 | 6/2005 |
| WO | WO 2005/059176 A1 | 6/2005 |
| WO | WO 2005/084134 A2 | 9/2005 |
| WO | WO 2005/111242 A2 | 11/2005 |
| WO | WO 2005/113803 A1 | 12/2005 |
| WO | WO 2006/076025 A2 | 7/2006 |
| WO | WO 2006/076205 A2 | 7/2006 |
| WO | WO 2006/110855 A2 | 10/2006 |
| WO | WO 2006/116155 A2 | 11/2006 |
| WO | WO 2006/138284 A2 | 12/2006 |
| WO | WO 2007/008759 A2 | 1/2007 |
| WO | WO 2007/134220 A2 | 11/2007 |
| WO | WO 2008/026927 A2 | 3/2008 |
| WO | WO 2008/039694 A2 | 4/2008 |
| WO | WO 2008/108803 A2 | 9/2008 |
| WO | WO 2008/147879 A1 | 12/2008 |
| WO | WO 2009/015296 A1 | 1/2009 |
| WO | WO 2009/017678 A2 | 2/2009 |
| WO | WO 2009/019657 A2 | 2/2009 |
| WO | WO 2009/021215 A1 | 2/2009 |
| WO | WO 2009/045898 A2 | 4/2009 |
| WO | WO 2009/070767 A2 | 6/2009 |
| WO | WO 2009/095567 A2 | 8/2009 |
| WO | WO 2009/108860 A2 | 9/2009 |
| WO | WO 2009/108866 A2 | 9/2009 |
| WO | WO 2009/137255 A2 | 11/2009 |
| WO | WO 2009/137832 A2 | 11/2009 |
| WO | WO 2009/145925 A1 | 12/2009 |
| WO | WO 2009/151628 A2 | 12/2009 |
| WO | WO 2009/152928 A2 | 12/2009 |
| WO | WO 2009/158521 A2 | 12/2009 |
| WO | WO 2010/011894 A1 | 1/2010 |
| WO | WO 2010/036352 A1 | 4/2010 |
| WO | WO 2010/053587 A2 | 5/2010 |
| WO | WO 2010/083456 A1 | 7/2010 |
| WO | WO 2010/151416 A1 | 12/2010 |
| WO | WO 2011/083296 A1 | 7/2011 |
| WO | WO 2011/083996 A2 | 7/2011 |
| WO | WO 2011/106738 A2 | 9/2011 |
| WO | WO 2011/107595 A1 | 9/2011 |
| WO | WO 2011/139371 A1 | 11/2011 |
| WO | WO 2011/139372 A1 | 11/2011 |
| WO | WO 2011/140433 A2 | 11/2011 |
| WO | WO 2012/012703 A2 | 1/2012 |
| WO | WO 2012/017081 A1 | 2/2012 |
| WO | WO 2012/027503 A2 | 3/2012 |
| WO | WO 2012/048340 A2 | 4/2012 |
| WO | WO 2012/048341 A2 | 4/2012 |
| WO | WO 2012/055929 A1 | 5/2012 |
| WO | WO 2012/061832 A1 | 5/2012 |
| WO | WO 2012/083069 A2 | 6/2012 |
| WO | WO 2012/083225 A2 | 6/2012 |
| WO | WO 2012/122484 A1 | 9/2012 |
| WO | WO 2012/142213 A2 | 10/2012 |
| WO | WO 2012/148497 A2 | 11/2012 |
| WO | WO 2012/159754 A2 | 11/2012 |
| WO | WO 2013/033721 A1 | 3/2013 |
| WO | WO 2013/036459 A2 | 3/2013 |
| WO | WO 2013/055595 A1 | 4/2013 |
| WO | WO 2013/059725 A1 | 4/2013 |

(56) References Cited

FOREIGN PATENT DOCUMENTS

| | | |
|---|---|---|
| WO | WO 2013/066726 A1 | 5/2013 |
| WO | WO 2013/085855 A1 | 6/2013 |
| WO | WO 2013/086450 A1 | 6/2013 |
| WO | WO 2013/086462 A1 | 6/2013 |
| WO | WO 2013/090390 A2 | 6/2013 |
| WO | WO 2013/090469 A1 | 6/2013 |
| WO | WO 2013/096480 A2 | 6/2013 |
| WO | WO 2013/123442 A1 | 8/2013 |
| WO | WO 2013/130512 A2 | 9/2013 |
| WO | WO 2013/131074 A1 | 9/2013 |
| WO | WO 2013/134162 A2 | 9/2013 |
| WO | WO 2013/134302 A1 | 9/2013 |
| WO | WO 2013/155119 A1 | 10/2013 |
| WO | WO 2013/158936 A1 | 10/2013 |
| WO | WO 2013/169957 A1 | 11/2013 |
| WO | WO 2013/181428 A2 | 12/2013 |
| WO | WO 2013/188471 A2 | 12/2013 |
| WO | WO 2013/188831 A1 | 12/2013 |
| WO | WO 2014/018460 A1 | 1/2014 |
| WO | WO 2014/026031 A1 | 2/2014 |
| WO | WO 2014/062945 A1 | 4/2014 |
| WO | WO 2014/062959 A1 | 4/2014 |
| WO | WO 2014/066184 A1 | 5/2014 |
| WO | WO 2014/130685 A1 | 8/2014 |
| WO | WO 2014/145992 A1 | 9/2014 |
| WO | WO 2015/002908 A1 | 1/2015 |
| WO | WO 2015/013461 A2 | 1/2015 |
| WO | WO 2015/058159 A1 | 4/2015 |
| WO | WO 2015/106161 A1 | 7/2015 |
| WO | WO 2015/134787 A2 | 9/2015 |
| WO | WO 2015/153788 A1 | 10/2015 |
| WO | WO 2015/160439 A2 | 10/2015 |
| WO | WO 2016/069886 A1 | 5/2016 |
| WO | WO 2016/138122 A1 | 9/2016 |
| WO | WO 2016/161273 A1 | 10/2016 |

OTHER PUBLICATIONS

Dueñas, M., et al. "In vitro immunization of naive human B cells yields high affinity immunoglobulin G antibodies as illustrated by phage display." Immunology (1996); 89.1: 1-7.
European Patent Application No. 14819680.1, Extended European Search Report dated Feb. 10, 2017, 10 pages.
PCT/US2016/025535, International Search Report and Written Opinion dated Jul. 11, 2016, 23 pages.
Abath et al. "Single-tubed nested PCR using immobilized internal primers", Biotechniques, 33(6): 1210-1212, 1214 (2002).
Abbott, et al. "Design and use of signature primers to detect carry-over of amplified material", J Virol Methods, 46(1):51-59, Abstract Only (1994).
Ahmadzadeh et al. "FOXP3 expression accurately defines the population of intratumoral regulatory T cells that selectively accumulate in metastatic melanoma lesions", Blood, 112(13): 4953-4960 (2008).
Akatsuka, Y. et al., "Rapid screening of T-cell receptor (TCR) variable gene usage by multiplex PCR: Application for assessment of clonal composition", Tissue Antigens, 53(2):122-134 (1999).
Alatrakchi et al. "T-cell clonal expansion in patients with B-cell lymphoproliferative disorders", Journal of Immunotherapy, 21(5):363-370 (1998).
Alexandre, D. et al. "H. sapiens rearranged T-cell receptor gamma chain gene, V2-JP1", GenBank accession No: X57737, NCBI, Nov. 14, 2006, 8 pages [online] [retrieved on Jun. 26, 2013] Retrieved from the internet <URL:http://www.ncbi.nlm.nih.gov/nuccore/x57737>.
Alexandre, D. et al. "H. sapiens rearranged T-cell receptor gamma chain gene, V3RS-J1 (hybrid joint)", GenBank accession No. X57740, NCBI, Feb. 11, 1997, 8 pages [online] [retrieved on Jun. 26, 2013] Retrieved from the internet <URL:http://www.ncbi.nlm.nih.gov/nuccore/x57740>.

Al-Lazikani, B. et al., "Standard Conformations for the Canonical Structures of Immunoglobulins," J. Mol. Biol., 273:927-948 (1997).
Altin et al. "The role of CD45 and CD45-associated molecules in T cell activation", Immunology and Cell Biology, 75: 430-445 (1997).
Altman, et al. "Phenotypic analysis of antigen-specific T lymphocytes", The Journal of Immunology, 187(1):7-9 (2011).
Altschul, et al. "Basic local alignment search tool", J Mol Biol., 215(3):403-410 (1990).
Andreasson, et al. "The human IgE-encoding transcriptome to assess antibody repertoires and repertoire evolution", J Mol Biol., 362(2):212-227 (2006). Epub Aug. 14, 2006.
Arnaout. "Specificity and overlap in gene segment-defined antibody repertoires", BMC Genomics, 6: 148 (2005).
Arden, et al. "Human T-cell receptor variable gene segment families", Immunogenetics, 42(6):455-500, Abstract Only (1995).
Armand, P. et al., "Detection of circulating tumour DNA in patients with aggressive B-cell non-Hodgkin lymphoma", Brit. J. Haematol., vol. 163, pp. 123-126 (2013).
Arstila, T.P., et al., "A direct estimate of the human αβ T cell receptor diversity," Science, 286(5441): 958-961 (1999).
Aslanzadeh. "Preventing PCR amplification carryover contamination in a clinical laboratory", Ann Clin Lab Sci., 34(4):389-396 (2004).
Assaf, et al. "High Detection Rate of T-Cell Receptor Beta Chain Rearrangements in T-Cell Lymphoproliferations by Family Specific Polymerase Chain Reaction in Combination with the Genescan Technique and DNA Sequencing", Blood, 96(2): 640-646 (2000).
Ateya, et al. "The good, the bad, and the tiny: a review of microflow cytometry", Anal Bioanal Chem., 391(5): 1485-1498 (2008). doi: 10.1007/s00216-007-1827-5. Epub Jan. 29, 2008.
Babrzadeh et al. "Development on High-throughput Sequencing Technology: emPCR Titration and Barcode Design", Stanford School of Medicine, 2 pages (2011).
Bagnara, et al. "IgV gene intraclonal diversification and clonal evolution in B-cell chronic lymphocytic leukaemia", British Journal of Haematology, 133(1):50-58 (2006).
Bahloul, M. et al., "Clinical impact of molecular diagnostics in low-grade lymphoma," Best Practice & Research Clinical Haematology, 18(1):97-111 (2005).
Baldauf, "Phylogeny for the faint of heart: a tutorial," Trends in Genetics, 19(6): 345-351 (2003).
Barbas, et al. "Assembly of combinatorial antibody libraries on phage surfaces: the gene III site", PNAS, 88(18): 7978-7982, Abstract Only (1991).
Barker, et al. "A second type II restriction endonuclease from Thermus aquaticus with an unusual sequence specificity", Nucleic Acids Res., 12(14): 5567-5581 (1984).
Batzoglou, S. "The many faces of sequence alignment", Briefings in Bioinformatics, 6:6-22 (2005).
Baum and McCune et al. "Direct measurement of T-cell receptor repertoire diversity with AmpliCot", Nat Methods, 3(11): 895-901 (2006).
Becker-André and Hahlbrock. "Absolute mRNA quantification using the polymerase chain reaction (PCR). A novel approach by a PCR aided transcript titration assay (PATTY)", Nucleic Acids Res., 17(22): 9437-9446 (1989).
Becton-Dickinson, CD marker handbook. bdbiosciences.com/go/mousecdmarkers, p. 1-47 (2010).
Becton-Dickinson T-Cell Research Tools, "Novel multicolor flow cytometry tools for the study of CD4+ T-cell differentiation and plasticity", 16 pages (2009).
Beishuizen, et al. "Analysis of Ig and T-cell receptor genes in 40 childhood acute lymphoblastic leukemias at diagnosis and subsequent relapse: implications for the detection of minimal residual disease by polymerase chain reaction analysis", Blood, 83(8):2238-2247 (1994).
Ben-Ezra, et al. Effect of fixation on the amplification of nucleic acids from paraffin-embedded material by the polymerase chain reaction, The Journal of Histochemistry and Cytochemistry, 39(3): 351-354 (1991).
Béné and Kaeda, "How and why minimal residual disease studies are necessary in leukemia: a review from WP10 and WP12 of the European LeukaemiaNet", Haematologica, 94(8):1135-1150 (2009).

(56) References Cited

OTHER PUBLICATIONS

Benecke. "DNA typing in forensic medicine and in criminal investigations: a current survey", *Naturwissenschaften*, 84(5): 181-188 (1997).
Benichou, J. et al., "Rep-Seq: uncovering the immunological repertoire through next-generation sequencing", *Immunology*, 135(3): 183-191 (2011).
Benichou, J. et al., "The restricted DH gene reading frame usage in the expressed human antibody repertoire is selected based upon its amino acid content", J Immunol., 190(11): 5567-77, 29 pages (2013).
Bentley, et al. "Accurate whole human genome sequencing using reversible terminator chemistry", *Nature*, 456(7218):53-59 (2008). doi: 10.1038/nature07517.
Bereczki, et al. "Optimization of PCR amplification for B- and T-cell clonality analysis on formalin-fixed and paraffin-embedded samples", *Pathology Oncology Research*, 13(3): 209-214 (2007). Epub Oct. 7, 2007.
Berger, et al. "The clonotypic T cell receptor is a source of tumor-associated antigens in cutaneous T cell lymphoma", *Annals of the New York Academy of Sciences*, 941:106-122, Abstract Only (2001).
Berget, et al. "Detection of clonality in follicular lymphoma using formalin-fixed, paraffin-embedded tissue samples and Biomed-2 immunoglobulin primers", J Clin Pathol., 64(1):37-41 (2011). doi: 10.1136/jcp/2010.081109. Epub Oct. 28, 2010.
Bernard et al. "Color multiplexing hybridization probes using the apolipoprotein E locus as a model system for genotyping", Anal Biochem., 273(2):221-228 (1999).
Bernardin, F. et al., "Estimate of the total number of CD8+ clonal expansions in healthy adults using a new DNA heteroduplex-tracking assay for CDR3 repertoire analysis", *Journal of Immunological Methods*, 274(12):159-175 (2003).
Berquam-Vrieze, K. et al., "Cell of origin strongly influences genetic selection in a mouse model of T-ALL", *Blood*, 118:4646-4656 (2011).
Bertness, et al. "T-Cell Receptor Gene Rearrangements as Clinical Markers of Human T-Cell Lymphomas", *The New England Journal of Medicine*, 313:534-538 (1985).
Berzofsky, et al. "Progress on new vaccine strategies for the immunotherapy and prevention of cancer", *J Clin Invest.*, 113(11): 1515-1525 (2004).
Biagi, et al. "Responses to human CD40 ligand/human interleukin-2 autologous cell vaccine in patients with B-cell chronic lymphocytic leukemia", *Clin Cancer Res.*, 11(19 Pt 1): 6916-6923 (2005).
Biggerstaff, et al. "Enumeration of leukocyte infiltration in solid tumors by confocal laser scanning microscopy", *BMC Immunol.*, 7:16, 13 pages (2006).
Blow, N., "PCR's next frontier," *Nature Methods*, 4(10):869-875 (2007).
Brochet et al. "IMGT/V-QUEST: the highly customized and integrated system for IG and TR standardized V-J and V-D-J sequence analysis", *Nucleic Acids Research*, vol. 36, Web Server issue W503-W508 (2008).
Bolotin, D.A. et al., "Next generation sequencing for TCR repertoire profiling: Platform-specific features and correction algorithms", *Eur. J. Immunol.*, 42:3073-3083 (2012).
Bonarius, H.P.J. et al. "Monitoring the T-Cell Receptor Repertoire at Single-Clone Resolution", *PLOS One*, 1(e55):1-10 (2006).
Bonner et al. "Fluorescence activated cell sorting", Rev Sci Instrum., 43(3):404-409, Abstract Only (1972).
Boria, et al. "Primer sets for cloning the human repertoire of T cell receptor variable regions", *BMC Immunology*, 9:50, 9 pages (2008).
Borst, et al. "False-positive results and contamination in nucleic acid amplification assays: suggestions for a prevent and destroy strategy", Eur J Clin Microbiol Infect Dis., 23(4):289-299, Abstract Only (2004). Epub Mar. 10, 2004.
Boudinot et al. "New perspectives for large-scale repertoire analysis of immune receptors", *Molecular Immunology*, 45: 2437-2445 (2008).

Bousso. "Generation of MHC-peptide tetramers: a new opportunity for dissecting T-cell immune responses", Microbes Infect., 2(4):425-429, Abstract Only (2000).
Boyce, et al. "Human regulatory T-cell isolation and measurement of function", *BD Biosciences*, pp. 1-20 (2010).
Boyd, S.D. et al., "Individual Variation in the Germline Ig Gene Repertoire Inferred from Variable Region Gene Rearrangements", *The Journal of Immunology*, 184(12): 6986-6992 (2010). Epub 2010.
Boyd, S.D. et al., "Measurement and Clinical Monitoring of Human Lymphocyte Clonality by Massively Parallel V-D-J Pyrosequencing," *Science Translational Medicine*, 1:12ra23, 40 pages, including Supplementary Materials (2009).
Bradfield, et al. "Graft-versus-leukemia effect in acute lymphoblastic leukemia: the importance of tumor burden and early detection", Leukemia, 18(6): 1156-1158 (2004).
Bravo and Irizarry. "Model-Based Quality Assessment and Base-Calling for Second-Generation Sequencing Data", Biometrics, 66(3): 665-674 (2010).
Brehm-Stecher and Johnson. "Single-cell microbiology: tools, technologies, and applications", *Microbiology and Molecular Biology Reviews*, 68(3):538-559 (2004).
Brenan, C. et al., "High throughput, nanoliter quantitative PCR," *Drug Discovery Today*: Technologies, 2(3):247-253 (2005).
Brenner, et al. "In vitro cloning of complex mixtures of DNA on microbeads: physical separation of differentially expressed cDNAs", *PNAS*, 97(4): 1665-1670 (2000).
Brennan et al. "Predictable αβ T-cell receptor selection toward an HLA-B*3501-restricted human cytomegalovirus epitope", J. Virol., 81(13): 7269-7273 (2007).
Brentjens, et al. "CD19-targeted T cells rapidly induce molecular remissions in adults with chemotherapy-refractory acute lymphoblastic leukemia", Sci Transl Med., 5(177): 177ra38 (2013). doi: 10.1126/scitranslmed.3005930.
Brisco, et al. "Determining the repertoire of IGH gene rearrangements to develop molecular markers for minimal residual disease in B-lineage acute lymphoblastic leukemia", *J Mol Diagn.*, 11(3):194-200 (2009).
Brisco, et al. "Outcome prediction in childhood acute lymphoblastic leukaemia by molecular quantification of residual disease at the end of induction", Lancet, 343:196-200 (1994).
Brockman et al, "Quality scores and SNP detection in sequencing-by-synthesis systems," Genome Research, 18: 763-770 (2008).
Brody, et al. "Active and passive immunotherapy for lymphoma: proving principles and improving results", J Clin Oncol., 29(14):1864-1875, Abstract Only (2011). doi: 10.1200/JC0.2010.33.4623. Epub Apr. 11, 2011.
Brody, et al., "Immunotransplant for mantle cell lymphoma: Phase I/II study preliminary results", *Journal of Clinical Oncology*, ASCO Annual Meeting Abstracts Part 1, vol. 29, No. 15, 1 page (2011).
Brody, et al. "Lymphoma immunotherapy: vaccines, adoptive cell transfer and immunotransplant", *Immunotherapy*, 1(5): 809-824 (2009). doi: 10.2217/imt.09.50.
Brown, et al. "Current techniques for single-cell lysis", *J. R. Soc. Interface*, 5:S131-S138 (2008).
Brownie et al. "The elimination of primer-dimer accumulation in PCR", Nucleic Acids Research, 25(16): 3235-3241 (1997).
Brüggemann, et al. "Clinical significance of minimal residual disease quantification in adult patients with standard-risk acute lymphoblastic leukemia", *Blood*, 107(3):1116-1123 (2006). Epub Sep. 29, 2005.
Brüggemann, et al. "Rearranged T-cell receptor beta genes represent powerful targets for quantification of minimal residual disease in childhood and adult T-cell acute lymphoblastic leukemia", *Leukemia*, 18(4): 709-719 (2004).
Brüggemann, et al. "Standardized MRD quantification in European All trials: proceedings of the Second International Symposium on MRD assessment in Kiel, Germany, Sep. 18-20, 2008", *Leukemia*, 24(3):521-535 (2010). doi: 10.1038/leu.2009.268. Epub Dec. 24, 2009.
Buck, G.A. et al. "Design Strategies and Performance of Custom DNA Sequencing Primers", *Biotechniques*, 27(3):528-536 (1999).

(56) References Cited

OTHER PUBLICATIONS

Buccisano, et al. "Prognostic and therapeutic implications of minimal residual disease detection in acute myeloid leukemia", Blood, 119(2):332-341 (2012). doi: 10.1182/blood-2011-08-363291. Epub Oct. 28, 2011.
Buccisano, et al. "Monitoring of minimal residual disease in acute myeloid leukemia", Curr Opin Oncol., 21(6):582-588, Abstract Only (2009). doi: 10.1097/CCO.0b013e3283311856.
Butkus, B. "Hutch Team Uses ddPCR to Quantify T-Cell Response in Tumors; Adaptive Biotech Eyes Market", PCR Insider, Dec. 12, 2013, 3 pages http://www.genomeweb.com/print/1323296.
Bystrykh. "Generalized DNA Barcode Design Based on Hamming Codes", PLoS ONE, 7(5): e36852, 1-8 (2012).
Campana, D., "Progress of Minimal Residual Disease Studies in Childhood Acute Leukemia," Curr Hematol Malig Rep, 5:169-176 (2010).
Campana. "Minimal residual disease in acute lymphoblastic leukemia", Semin Hematol.,46(1):100-106 (2009).
Campana, et al. "Role of minimal residual disease monitoring in adult and pediatric acute lymphoblastic leukemia", Hematol Oncol Clin North Am., 23(5): 1083-1098 (2009). doi: 10.1016/j.hoc.2009.07.010.
Campbell et al. "Subclonal phylogenetic structures in cancer revealed by ultra-deep sequencing," PNAS, 105(35):13081-13086 (2008).
Caporaso, J.G. et al. "Global patterns of 16S rRNA diversity at a depth of millions of sequences per sample", PNAS, 108(Suppl. 1):4516-4522 (2010).
Carlotti, et al. "Transformation of follicular lymphoma to diffuse large B-cell lymphoma may occur by divergent evolution from a common progenitor cell or by direct evolution from the follicular lymphoma clone", Blood, 113(15): 3553-3557 (2009). doi: 10.1182/blood-2008-08-174839. Epub Feb. 6, 2009.
Carlson et al. "Profiling the repertoire of TCRB usage in induced and natural Treg cells", The Journal of Immunology, 186: 62.5, Abstract (2011).
Carlson, et al. "Immune Profiling Suggests an IGH Signaling-Dependent Subtype of Aggressive B-ALL", Blood, 120: 1428, Abstract (2012).
Carlson, et al. "Deep sequencing of the human TCRγ and TCRβ repertoires provides evidence that TCRβ rearranges after αβ, γδT cell commitment". Presented at the ASHG 2011 Conference. Oct. 2011. Poster. 1 page.
Carlson, et al. "Detection of tumor tagging clones in multiple myeloma via high throughput sequencing is robust to significant levels of SHM", Presented for the 2014 ASH Annual Meeting. Poster. 1 page. Dec. 5-9, 2014.
Carlson, C.S. et al. "Using synthetic templates to design an unbiased multiplex PCR assay", Nature Communications, 4:2680, pp. 1-9 (2013).
Casali, et al. "Human monoclonals from antigen-specific selection of B lymphocytes and transformation by EBV", Science, 234(4775): 476-479, Abstract Only (1986).
Casbon et al. "A method for counting PCR template molecules with application to next-generation sequencing", Nucleic Acids Research, 39(12): e81, 8 pages (2011).
Catherwood, M.A. et al., "Improved clonality assessment in germinal centre/post germinal centre non-Hodgkin's lymphomas with high rates of somatic hypermutation", J. Clin. Pathol., 60:524-528, Abstract (2007).
Cavé, H. et al., "Clinical Significance of minimal residual disease in childhood acute lymphoblastic leukemia," The New England Journal of Medicine, 339:591-598 (1998).
Chan et al. "Evaluation of Nanofluidics Technology for High-Throughput SNP Genotyping in a Clinical Setting", The Journal of Molecular Diagnostics, 13(3): 305-312 (2011).
Chattopadhyay, et al. "A live-cell assay to detect antigen-specific CD4+ T cells with diverse cytokine profiles", Nat Med., 11(10): 1113-1117 (2005). Epub Sep. 25, 2005.

Chen et al. "A novel approach for the analysis of T-cell reconstitution by using a T-cell receptor β-based oligonucleotide microarray in hematopoietic stem cell transplantation", Exp Hematol., 35(5):831-841 (2007).
Chen et al. "Identification of racehorse and sample contamination by novel 24-plex STR system", Forensic Science International: Genetics, 4:158-167 (2010).
Chen, et al. "Microfluidic cell sorter with integrated piezoelectric actuator", Biomed Microdevices, 11(6): 1223-1231 (2009). doi: 10.1007/s10544-009-9341-5.
Chen, Y. et al., "T-cell receptor gene expression in tumour-infiltrating lymphocytes and peripheral blood lymphocytes of patients with nasopharyngeal carcinoma", British Journal of Cancer, 72(1): 117-22 (1995).
Chen, et al. "Total Gene Synthesis: Novel Single-Step and Convergent Strategies Applied to the Construction of a 779 Base Pair Bacteriorhodopsis", Gene. J. Am. Chem Soc., 116: 8799-8800, Abstract Only (1994).
Chinese Application No. 201380042163.X, Search Report dated Apr. 12, 2016 (English translation), 2 pages.
Chiu, et al. "Non-invasive prenatal assessment of trisomy 21 by multiplexed maternal plasma DNA sequencing: large scale validity study", BMJ, 342:c7401, 9 pages (2011). doi: 10.1136/bmj.c7401.
Choi, et al. "Relapse in children with acute lymphoblastic leukemia involving selection of a preexisting drug-resistant subclone", Blood, 110(2):632-639 (2007).
Choi, et al. "Clonal evolution in B-lineage acute lymphoblastic leukemia by contemporaneous $V_H$-$V_H$ gene replacements and $V_H$-$DJ_H$ gene rearrangements", Blood, 87(6):2506-2512 (1996).
Chothia, C. et al. "Canonical structures for the hypervariable regions of immunoglobulins," J. Mol. Biol., 196:901-917, Abstract only (1987).
Chothia, C. et al. "Conformations of immunoglobulin hypervariable regions," Nature, 342:877-883 (1989).
Churchill and Waterman. "The Accuracy of DNA Sequences: Estimating Sequence Quality", Genomics, 14:89-98 (1992).
Chute, et al. "Detection of immunoglobulin heavy chain gene rearrangements in classic Hodgkin lymphoma using commercially available BIOMED-2 primers", Diagn Mol Pathol., 17(2): 65-72 (2008). doi: 10.1097/PDM.0b013e318150d695.
Citri et al. "Comprehensive qPCR profiling of gene expression in single neuronal cells", Nature Protocols, 7(1): 118-127 (2012).
Ciudad, J. et al. "Detection of abnormalities in B-cell differentiation pattern is a useful tool to predict relapse in precursor-B-ALL", British Journal of Haematology, 104:695-705 (1999).
Cleary, et al. "Production of complex nucleic acid libraries using highly parallel in situ oligonucleotide synthesis", Nat Methods, 1(3): 241-248 (2004). Epub Nov. 18, 2004.
Clemente, et al. "Deep sequencing of the T-cell receptor repertoire in CD8+T-large granular lymphocyte leukemia identifies signature landscapes", Blood, 122(25): 4077-85 (2013). doi: 10.1182/blood-2013-05-506386. Epub Oct. 22, 2013.
Cooper, et al. "BRAF inhibition is associated with increased clonality in tumor infiltrating lymphocytes", Oncoimmunology, 2(10):e26615 (2013). Epub Oct. 15, 2013.
Costabile, et al. "Molecular approaches in the diagnosis of primary immunodeficiency diseases", Human Mutation, 27(12):1163-1173 (2006).
Coustan-Smith, E. et al., "Clinical importance of minimal residual disease in childhood acute lymphoblastic leukemia," Blood, 96(8):2691-2696 (2000).
Coustan-Smith, E. et al., "Early T-cell precursor leukaemia: a subtype of very high-risk acute lymphoblastic leukaemia," Lancet Oncology, 10:147-156 (2009).
Coustan-Smith, E. et al., "Prognostic importance of measuring early clearance of leukemic cells by flow cytometry in childhood acute lymphoblastic leukemia", Blood, 100(1):52-58 (2002).
Craig et al. "Identification of genetic variants using bar-coded multiplex sequencing", Nature Methods, 5(10): 887-893 (2008) and Supplemental Materials.

(56) References Cited

OTHER PUBLICATIONS

Cronin, et al. "Comprehensive next-generation cancer genome sequencing in the era of targeted therapy and personalized oncology", *Biomark Med.*, 5(3):293-305 (2011). (Abstract only). doi: 10.2217/bmm.11.37.

Cronn et al. "Multiplex sequencing of plant chloroplast genomes using Solexa sequencing-by-synthesis technology", *Nucleic Acids Research*, 36(19):e122, 1-11 (2008).

Curran et al. "Nucleotide sequencing of psoriatic arthritis tissue before and during methotrexate administration reveals a complex inflammatory T cell infiltrate with very few clones exhibiting features that suggest they drive the inflammatory process by recognizing autoantigens", *The Journal of Immunology*, 172:1935-1944 (2004).

Curran-Everett, D., "Multiple comparisons: philosophies and illustrations", *Am J Physiol Regulatory Integrative Comp Physiol.*, 279:R1-R8 (2000).

Currier and Robinson. "Spectratype/immunoscope analysis of the expressed TCR repertoire", *Current Protocols in Immunology*, Supplement 38:10.28.1-10.28.24 (2000).

Dahl et al. "Multiplex amplification enabled by selective circularization of large sets of genomic DNA fragments", Nucleic Acids Res., 33(8): e71 (2005).

Damle et al. "B-cell chronic lymphocytic leukemia cells express a surface membrane phenotype of activated, antigen-experienced B lymphocytes", *Blood*, 99(11): 4087-93 (2002).

Dash, P. et al., "Paired analysis of TCR[alpha] and TCR[beta] chains at the single-cell level in mice", *Journal of Clinical Investigation*, 121(1):288-295 (2011).

Davi, et al. "Lymphocytic progenitor cell origin and clonal evolution of human B-lineage acute lymphoblastic leukemia", *Blood*, 88(2):609-621 (1996).

Davila, et al. Efficacy and toxicity management of 19-28z CART cell therapy in B cell acute lymphoblastic leukemia, Sci Transl Med., 6(224):224ra25 (2014). doi: 10.1126/scitranslmed.3008226.

Davis, et al. "Interrogating the repertoire: broadening the scope of peptide-MHC multimer analysis", *Nat Rev Immunol.*, 11(8):551-558 (2011). doi: 10.1038/nri3020.

Davis, et al. "Staining of cell surface human CD4 with 2'-F-pyrimidine-containing RNA aptamers for flow cytometry", *Nucleic Acids Research*, 26(17):3915-3924 (1998).

De Bona et al. "Optimal spliced alignments of short sequence reads", *Bioinformatics*, 9(Suppl 10):O7, 2 pages (2008).

De Jonge, H.J.M., et al. "Evidence Based Selection of Housekeeping Genes," *PLoS One*, 9(e898):1-5 (2007).

Dean, et al. "Rapid amplification of plasmid and phage DNA using Phi 29 DNA polymerase and multiply-primed rolling circle amplification", *Genome Res.*, 11(6): 1095-1099 (2001).

Decoste et al. "Relative and Absolute Quantitative Real-Time PCR-Based Quantifications of hcnC and phlD Gene Transcripts in Natural Soil Spiked with *Pseudomonas* sp. Strain LBUM300", *Applied and Environmental Microbiology*, 77(1): 41-47 (2011).

Dedhia, et al. "Evaluation of DNA extraction methods and real time PCR optimization on formalin-fixed paraffin-embedded tissues", *Asian Pac J Cancer Prev.*, 8(1): 55-59 (2007).

Deiman, et al. "Characteristics and applications of nucleic acid sequence-based amplification (NASBA)", *Mol Biotechnol.*, 20(2): 163-179, Abstract Only (2002).

DeKosky et al. "High-throughput sequencing of the paired human immunoglobulin heavy and light chain repertoire", *Nature Biotechnology*, 31(2): 166-169 (2013).

Delaney, et al. "Evolution and Clinical Implications of the T cell Repertoire Following Cord Blood Transplant", Biology of Blood and Marrow Transplant, vol. 19, Issue 2, S201-S202. Published Feb. 2013.

Deng et al. "Gene profiling involved in immature CD4+ T lymphocyte responsible for systemic lupus erythematosus", *Molecular Immunology*, 43:1497-1507 (2006).

DeNucci, C.C. et al. "Integrin function in T-cell homing to lymphoid and nonlymphoid sites: getting there and staying there," *Critical Reviews in Immunology*, 29(2):87-109 (2009).

Deschoolmeester, et al. "Tumor infiltrating lymphocytes: an intriguing player in the survival of colorectal cancer patients", *BMC Immunology*, 11:19, 12 pages (2010). doi: 10.1186/1471-2172-11-19.

Desmarais, et al. "Deep profiling of the mouse TCRβ CDR3 region in thymus and spleen". Oct. 2010. Poster. 1 page.

Desmarais, et al. High-throughput sequencing of memory and naïve T cell receptor repertoires at the RNA and DNA levels reveals differences in relative expression of expanded TCR clones. Adaptive Technologies. Seattle W A. Poster, 1 page. Presented May 5, 2012.

Desmarais and Robins. "High-throughput sequencing of memory and naïve T cell receptor repertoires at the RNA and DNA levels reveals differences in relative expression of expanded TCR clones", The Journal of Immunology, 182: 178.12 (2012).

Dheda, K., et al. "Validation of housekeeping genes for normalizing RNA expression in real-time PCR," *Bio Techniques*, 37:112-119 (2004).

Dictor et al. "Resolving T-cell receptor clonality in two and genotype in four multiplex polymerase chain reactions", *Haematologica*, 90(11): 1524-1532 (2005).

Diederichsen, et al. "Prognostic value of the CD4+/CD8+ ratio of tumour infiltrating lymphocytes in colorectal cancer and HLA-DR expression on tumour cells", *Cancer Immunol Immunother.*, 52(7):423-428 (2003). Epub Apr. 15, 2003.

Diehl, et al. "BEAMing: single-molecule PCR on microparticles in water-in-oil emulsions", *Nat Methods*, 3(7):551-559, Abstract Only (2006).

Dik, W., et al. "New insights on human T cell development by quantitative T cell receptor gene rearrangement studies and gene expression profiling," JEM, 201(11):1715-1723 (2005).

Diluvio et al. "Identical TCRβ-chain rearrangements in streptococcal angina and skin lesions of patients with psoriasis vulgaris", *J Immunol.*, 176(11 ): 7104-11 (2006).

Ding, et al. "Clonal evolution in relapsed acute myeloid leukaemia revealed by whole-genome sequencing", *Nature*, 481(7382):506-510 (2012). doi: 10.1038/nature10738.

Diviacco, et al. "A novel procedure for quantitative polymerase chain reaction by coamplification of competitive templates", *Gene*, 122(2):313-320 (1992).

Do and Batzoglou. "What is the expectation maximization algorithm?", *Nature Biotechnology*, 26(8): 897-899 (2008).

Dobosy, J. et al. "RNase H-dependent PCR (rhPCR): improved specificity and single nucleotide polymorphism detection using blocked cleavable primers", *BMC Biotechnology*, 11(80):1-18 (2011).

Dohm, et al. "Substantial biases in ultra-short read data sets from high throughput DNA sequencing", *Nucleic Acids Research*, 36:e105, 10 pages (2008).

Dou, et al. "Analysis of T cell receptor $V_\beta$ gene usage during the course of disease in patients with chronic hepatitis B", *Journal of Biomedical Science*, 5(6):428-434 (1998).

Dressman, et al. "Transforming single DNA molecules into fluorescent magnetic particles for detection and enumeration of genetic variations", PNAS, 100(15):8817-8822 (2003). Epub Jul. 11, 2003.

Drmanac, et al. "Human genome sequencing using unchained base reads on self-assembling DNA nanoarrays", *Science*, 327(5961):78-81 (2010). doi: 10.1126/science.1181498. Epub Nov. 5, 2009.

Droege, et al. "The Genome Sequencer FLX System—longer reads, more applications, straight forward bioinformatics and more complete data sets", J Biotechnol., 136(1-2):3-10 (2008). doi: 10.1016/j.jbiotec.2008.03.021. Epub Jun. 21, 2008.

Droese, J., et al. "Validation of BIOMED-2 multiplex PCR tubes for detection of TCRB gene rearrangements in T-cell malignancies," *Leukemia*, 18:1531-1538 (2004).

Drossman, et al. "High-speed separations of DNA sequencing reactions by capillary electrophoresis", *Anal Chem.*, 62(9): 900-903 (1990).

(56) References Cited

OTHER PUBLICATIONS

Du et al. "TCR spectratyping revealed T lymphocytes associated with graft-versus-host disease after allogeneic hematopoietic stem cell transplantation", *Leukemia & Lymphoma*, 48(8):1618-1627 (2007).
Duby, A.D. et al., "Human T-cell receptor aberrantly rearranged beta-chain J1.5-Dx-J2.1 gene," PNAS, GenBank accession No. M13574.1, bases 1 to 100, 4 pages (1986).
Dudgeon, et al. "The evolution of thymic lymphomas in p53 knockout mice", Genes Dev., 28(23): 2613-20 (2014). doi: 10.1101/gad.252148.114.
Dunn, et al. "Focus on TILs: Prognostic significance of tumor infiltrating lymphocytes in human glioma", *Cancer Immun.*, 7:12, 16 pages (2007).
Eason et al. "Characterization of synthetic DNA bar codes in Saccharomyces cerevisiae gene-deletion strains," PNAS, 101(30): 11046-11051 (2004).
Edd et al. "Controlled encapsulation of single cells into monodisperse picoliter drops", *Lab Chip*, 8(8):1262-1264 (2008).
Edwards and Gibbs, "Multiplex PCR: advantages, development, and applications," Genome Research, 3:S65-S75 (1994).
Eichler, et al. "Haplotype and interspersion analysis of the FMR1 CGG repeat identifies two different mutational pathways for the origin of the fragile X syndrome", *Hum Mol Genet.*, 5(3):319-330 (1996).
Eichler, et al. "Length of uninterrupted CGG repeats determines instability in the FMR1 gene", *Nat Genet.*, 8(1):88-94, Abstract Only (1994).
Eid et al. "Real-time DNA sequencing from single polymerase molecules", *Science*, 323(5910):133-138 (2009). doi: 10.1126/science.1162986. Epub Nov. 20, 2008.
Eis, et al. "An invasive cleavage assay for direct quantitation of specific RNAs", *Nat Biotechnol.*, 19(7):673-676, Abstract Only (2001).
Eisenstein. "Personalized, sequencing-based immune profiling spurs startups", Nat Biotechnol., 31(3):184-6 (2013). doi: 10.1038/nbt0313-184b.
Elkord et al. "T regulatory cells in cancer: recent advances and therapeutic potential", *Expert Opinion on Biological Therapy*, 10(11): 1573-1586 (2010).
Elnifro, E.M., et al. "Multiplex PCR: Optimization and Application in Diagnostic Virology", *Clinical Microbiology Reviews*, 13(4):559-570 (2000).
Emerson, et al. "Correlation of TCR diversity with immune reconstitution after cord blood transplant", Presented at the American Society of Clinical Oncology's annual meeting. May, 2012. Poster. 1 page.
Emerson et al. "Defining the Alloreactive T Cell Repertoire Using High-Throughput Sequencing of Mixed Lymphocyte Reaction Culture", *PLoS One*, 9(11): e111943 (2014).
Emerson, R.O. et al. "High-throughput sequencing of T-cell receptors reveals a homogeneous repertoire of tumour-infiltrating lymphocytes in ovarian cancer", *Journal of Pathology*, 231: 433-440 (2013).
Emerson, et al. "CD4+ and CD8+ T cell β antigen receptors have different and predictable V and J gene usage and CDR3 lengths", Presented at the Annual Meeting of the American Association of Immunologists 2012 in Boston, MA May, 2012. Poster.
Emerson, et al. "Estimating the ratio of CD4+ to CD8+T cells using high-throughput sequence data", J Immunol Methods, 391(1-2):14-21 (2013). doi: 10.1016/j.jim.2013.02.002. Epub Feb. 18, 2013.
Emerson, et al. TCR repertoire diversity assessed with immunosequencing is associated with patient mortality following cord blood transplant. Presented for the 2014 ASH Annual Meeting. Poster. 1 page. Dec. 5-9, 2014.
Estorninho, et al. "A novel approach to tracking antigen-experienced CD4 T cells into functional compartments via tandem deep and shallow TCR clonotyping", J Immunol., 191(11): 5430-40 (2013). doi: 10.4049/jimmunol.1300622. Epub Oct. 25, 2013.

Erlich, et al. "Alta-Cyclic: a self-optimizing base caller for next-generation sequencing", *Nat Methods.*, 5(8): 679-682 (2008). doi: 10.1038/nmeth.1230. Epub Jul. 6, 2008.
European Application No. 09764927.1, Notice of Opposition dated Oct. 14, 2014, Reference# 547-7.
European Application No. 09764927.1, Notice of Opposition dated Oct. 14, 2014, Reference#BR0-0001EP.
European Application No. 09764927.1, European Opposition dated Oct. 15, 2014 (in French only).
Esendagli et al. "Malignant and non-malignant lung tissue areas are differentially populated by natural killer cells and regulatory T cells in non-small cell lung cancer", *Lung Cancer*, 59(1): 32-40 (2008).
European Application No. 10732172.1, Extended European Search Report dated May 29, 2012, 5 pages.
European Application No. 16162568.6, Extended European Search Report dated Jul. 20, 2016, 6 pages.
European Patent Application No. 13195379.6, European Search Report and Opinion dated Mar. 13, 2014, 6 pages.
European Patent Application No. 11777704.5, European Search Report dated Jul. 26, 2013, 6 pages.
European Patent Application No. 13828563.0, Extended European Search Report dated Feb. 12, 2016, 10 pages.
European Patent Application No. 13804085.2, Extended European Search Report dated Nov. 16, 2015, 10 pages.
European Patent Application No. 13775514.6, Extended European Search Report dated Dec. 1, 2015, 12 pages.
European Patent Application No. 13757482.8, Extended European Search Report dated Jun. 6, 2016, 5 pages.
European Patent Application No. 16165939.6, Extended European Search Report dated Oct. 7, 2016, 9 pages.
European Patent Application No. 09764927.1, EPO's Communication of Notices of Opposition, dated Nov. 21, 2014.
European Patent Application No. 09764927.1, Patentee's Observations/Response dated May 27, 2015.
European Patent Application No. 09764927.1, Opponent's Response to Submission of the Patentee dated Nov. 23, 2015.
Ewing and Green, "Base-calling of automated sequencer traces using Phred. I. Accuracy Assessment," Genome Research, 8: 175-185 (1998).
Faham, M. et al. "Deep-sequencing approach for minimal residual disease detection in acute lymphoblastic leukemia", *Blood*, 120(26): 5173-5180 (2012).
Felsenstein, et al. "Evolutionary Trees from DNA Sequences: A Maximum Likelihood Approach", J Mol Evol, 17:368-376 (1981).
Ferradini et al. "Analysis of T Cell Receptor Variability in Tumor-infiltrating Lymphocytes from a Human Regressive Melanoma", *J. Clin. Invest.*, pp. 1183-190 (1993).
Ferrero, et al. "Multiple myeloma shows no intra-disease clustering of immunoglobulin heavy chain genes", *Haematologica*, 97(6): 849-853 (2012). doi: 10.3324/haematol.2011.052852. Epub Dec. 29, 2011.
Fisher et al. "The Relation Between the Number of Species and the Number of Individuals in a Random Sample of an Animal Population", *Journal of Animal Ecology*, 12(1): 42-58 (1943).
Flaherty et al. "Ultrasensitive detection of rare mutations using next-generation targeted resequencing", *Nucleic Acids Research*, 40(1): e2, 12 pages (2012).
Flicek and Birney, "Sense from sequence reads: methods for alignment and assembly," Nature Methods Supplement, 6(11s): S6-S12 (2009).
Flohr, T., et al. "Minimal residual disease-directed risk stratification using real-time quantitative PCT analysis of immunoglobulin and T-cell receptor gene rearrangements in the international multicenter trial AIEOP-BFM ALL 2000 for childhood acute lymphoblastic leukemia", *Leukemia*, 22:771-782 (2008).
Frampton, et al. "Development and validation of a clinical cancer genomic profiling test based on massively parallel DNA sequencing", *Nat Biotechnol.*, 31(11): 1023-1031 (2013). doi: 10.1038/nbt.2696. Epub Oct. 20, 2013.
Frank. "BARCRAWL and BARTAB: software tools for the design and implementation of barcoded primers for highly multiplexed DNA sequencing," *BMC Bioinformatics*, 10: 362 (2009).

(56) References Cited

OTHER PUBLICATIONS

Frederiksson et al., "Multiplex amplification of all coding sequences within 10 cancer genes by Gene-Collector", Nucleic Acids Research, 35(7): e47 (2007).
Freeman, et al. "Quantitative RT-PCR: Pitfalls and Potential", Biotechniques, 6(1): 112-125 (1999).
Freeman, J.D., et al. "Profiling the T-Cell Receptor Beta-Chain Repertoire by Massively Parallel Sequencing", Genome Research, 19(10):1817-1824 (2009). Epub Jun. 18, 2009.
Fridman, et al. "Prognostic and predictive impact of intra- and peritumoral immune infiltrates", Cancer Research, 71(17): 5601-5605 (2011). doi: 10.1158/0008-5472.CAN-11-1316. Epub Aug. 16, 2011.
Fritz et al. "Alterations in the spinal cord T cell repertoire during relapsing experimental autoimmune encephalomyelitis," J Immunol, 164:6662-6668 (2000).
Fu et al. "Counting individual DNA molecules by the stochastic attachment of diverse labels", PNAS, 108(22): 9026-9031 and Supporting Materials, 8 pages (2011).
Fuller, et al. "The challenges of sequencing by synthesis", Nat Biotechnol., 7(11): 1013-23 (2009) (Abstract only). doi: 10.1038/nbt.1585. Epub Nov. 6, 2009.
Furmanski, et al. "Public T cell receptor β-chains are not advantaged during positive selection", The Journal of Immunology, 180(2): 1029-39 (2008).
García-Castillo and Nínez, et al. "Detection of clonal immunoglobulin and T-cell receptor gene recombination in hematological malignancies: monitoring minimal residual disease", Cardiovascular & Haematological Disorders-Drug Targets, 9:124-135 (2009).
Gauss, et al. "Mechanistic constraints on diversity in human V(D)J recombination", Mol Cell Biol., 16(1):258-269 (1996).
Gawad, et al. "Massive evolution of the immunoglobulin heavy chain locus in children with B precursor acute lymphoblastic leukemia", Blood, 120(22):4407-4417 (2012). doi: 10.1182/blood-2012-05-429811. Epub Aug. 28, 2012.
Gerlinger and Swanton. "How Darwinian models inform therapeutic failure initiated by clonal heterogeneity in cancer medicine", British Journal of Cancer, 103(8):1139-1143 (2010). doi: 10.1038/sj.bjc.6605912. Epub Sep. 28, 2010.
Gerlinger, M. et al. "Ultra deep T cell receptor sequencing reveals the complexity and intratumour heterogeneity of T cell clones in renal cell carcinomas", Journal of Pathology, 231:424-432 (2013).
Germano, et al. "Clonality profile in relapsed precursor-B-ALL children by GeneScan and sequencing analyses. Consequences on minimal residual disease monitoring", Leukemia, 17(8):1573-1582 (2003).
Giannoni, et al. Allelic exclusion and peripheral reconstitution by TCR transgenic T cells arising from transduced human hematopoietic stem/progenitor cells, Mol Ther., 21(5):1044-54 (2013). doi: 10.1038/mt.2013.8. Epub Feb. 5, 2013.
GIGA—Roche 454 FLX technology how it works. Fiche technique du Centre Interdisciplinaire de Genoproteomique Appliquee (Universite de Liege, Belgique). Accessed Oct. 15, 2014.
Gilbert, et al. "The isolation of nucleic acids from fixed, paraffin-embedded tissues-which methods are useful when?", PLoS One, 2(6):e537, 12 pages (2007).
Giuggio, et al. "Evolution of the intrahepatic T cell repertoire during chronic hepatitis C virus infection", Viral Immunology, 18(1):179-189 (2005).
Gloor et al. "Microbiome profiling by Illumina sequencing of combinatorial sequence-tagged PCR products," PLoS ONE, 5(10): e15406, 15 pages (2010).
Godelaine, et al. "Polyclonal CTL responses observed in melanoma patients vaccinated with dendritic cells pulsed with a MAGE-3.A1 peptide", J Immunol., 171(9):4893-4897 (2003).
Golembowski, et al. "Clonal evolution in a primary cutaneous follicle center B cell lymphoma revealed by single cell analysis in sequential biopsies", Immunobiology, 201(5):631-644 (2000).
Gomes, et al. "Single-tube nested PCR using immobilized internal primers for the identification of dengue virus serotypes", J Virol Methods., 145(1):76-9 (2007). Epub Jun. 15, 2007.
Gonzalez, et al. "Incomplete DJH rearrangements of the IgH gene are frequent in multiple myeloma patients: immunobiological characteristics and clinical implications", Leukemia, 17:1398-1403 (2003).
Gonzalez et al., "Incomplete DJH rearrangements as a novel tumor target for minimal residual disease quantitation in multiple myeloma using real-time PCR", Leukemia, 17:1051-1057 (2003).
Gonzalez, S.F., et al. "Trafficking of B Cell Antigen in Lymph Nodes", Ann. Rev. Immunol., 29: 215-233 (2011).
Gopalakrishnan, et al. "Unifying model for molecular determinants of the preselection Vβ repertoire", Proc Natl Acad Sci USA, 110(34):E3206-15 (2013). doi: 10.1073/pnas.1304048110. Epub Aug. 5, 2013.
Gorski, et al. "Circulating T cell repertoire complexity in normal individuals and bone marrow recipients analyzed by CDR3 size spectratyping. Correlation with immune status", J Immunol., 152(10):5109-5119 (1994).
Gottenberg, et al. "Markers of B-lymphocyte activation are elevated in patients with early rheumatoid arthritis and correlated with disease activity in the ESPOIR cohort", Arthritis Res Ther., 11(4): R114 (2009). doi: 10.1186/ar2773. Epub Jul. 23, 2009.
Gratama and Kern. "Flow cytometric enumeration of antigen-specific T lymphocytes", Cytometry A, 58(1): 79-86 (2004).
Gratama, et al. "Measuring antigen-specific immune responses", 2008 update. Cytometry A., 73(11): 971-974 (2008). doi: 10.1002/cyto.A.20655.
Green, et al. "Clonal diversity of Ig and T-cell-receptor gene rearrangements identifies a subset of childhood B-precursor acute lymphoblastic leukemia with increased risk of relapse", Blood, 92(3):952-958 (1998).
Greenberg, et al. "Profile of immunoglobulin heavy chain variable gene repertoires and highly selective detection of malignant clonotypes in acute lymphoblastic leukemia" J Leukoc Biol., 57(6):856-864 (1995).
Greenman, et al. "Patterns of somatic mutation in human cancer genomes", Nature, 446(7132): 153-158 (2007).
Gribben, JG. "Stem cell transplantation in chronic lymphocytic leukemia", Biol. Blood Marrow Transplant., 15(1 Suppl): 53-58 (2009). doi: 10.1016/j.bbmt.2008.10.022.
Grupp, et al. "Chimeric antigen receptor-modified T cells for acute lymphoid leukemia", N Engl J Med., 368(16):1509-18 (2013). doi: 10.1056/NEJMoa1215134. Epub Mar. 25, 2013.
Grupp, et al. "Adoptive transfer of autologous T cells improves T-cell repertoire diversity and long-term B-cell function in pediatric patients with neuroblastoma", Clin Cancer Res., 18(24):6732-41 (2012). doi: 10.1158/1078-0432.CCR-12-1432. Epub Oct. 23, 2012.
Gulliksen, et al. "Real-time nucleic acid sequence-based amplification in nanoliter volumes", Anal Chem., 76(1): 9-14, Abstract Only (2004).
Gunderson et al. "Decoding Randomly Ordered DNA Arrays", Genome Research, 14: 870-877 (2004).
Guo, et al. "Sequence changes at the V-D junction of the $V_H1$ heavy chain of anti-phosphocholine antibodies alter binding to and protection against Streptococcus pneumoniae", Int Immunol., 9(5):665-677 (1997).
Gupta, Pushpendra K. "Single-molecule DNA sequencing technologies for future genomics research", Trends Biotechnol., 26(11): 602-611 (2008). doi: 10.1016/j.tibtech.2008.07.003. Epub Aug. 21, 2008.
Gurrieri, et al. "Chronic lymphocytic leukemia B cells can undergo somatic hypermutation and intraclonal immunoglobulin $V_HDJ_H$ gene diversification", J Exp Med., 196(5):629-639 (2002).
Hadrup, et al. "Parallel detection of antigen-specific T-cell responses by multidimensional encoding of MHC multimers", Nat Methods, 6(7): 520-526 (2009) (Abstract Only). doi: 10.1038/nmeth.1345. Epub Jun. 21, 2009.
Halldórsdóttir, et al. "Application of BIOMED-2 clonality assays to formalin-fixed paraffin embedded follicular lymphoma specimens: superior performance of the IGK assays compared to IGH for suboptimal specimens", Leukemia & Lymphoma, 48(7): 1338-1343 (2007).

(56) References Cited

OTHER PUBLICATIONS

Hamady, et al. "Error-correcting barcoded primers for pyrosequencing hundreds of samples in multiplex", Nature Methods, 5(3):235-237 (2008). doi: 10.1038/nmeth.1184. Epub Feb. 10, 2008.
Han et al. "Immunorepertoire analysis by multiplex PCR amplification and high throughput sequencing", The Journal of Immunology, 182:42.6, 1 page (2009).
Hanahan, et al. "Hallmarks of cancer: the next generation", Cell, 144(5): 646-674 (2011). doi: 10.1016/j.cell.2011.02.013.
Harismendy et al. "Evaluation of next generation sequencing platforms for population targeted sequencing studies", Genome Biology, 10:R32, 13 pages (2009).
Harris et al. "Single-Molecule DNA Sequencing of a Viral Genome", Science, 320: 106-109 (2008).
Hathcock, et al. "ATM influences the efficiency of TCRβ rearrangement, subsequent TCRβ-dependent T cell development, and generation of the pre-selection TCRβ CDR3 repertoire", PLoS One, 8(8):e62188 (2013). doi: 10.1371/journal.pone.0062188. Print 2013.
Hawkins, et al. "Whole genome amplification—applications and advances", Curr Opin Biotechnol., 13(1): 65-67 (2002).
He, et al. "IgH gene rearrangements as plasma biomarkers in Non-Hodgkin's lymphoma patients", Oncotarget, 2(3): 178-185 (2011).
Heger, M. "Studies Highlight Challenges of Immune Repertoire Sequencing's Clinical Applicability", available at http://www.genomeweb.com/sequencing/studies-highlight-challenges-immune-repertoire-sequencings-clinical-applicabilit?hq_e=el&hq_m=966798&hq_I=10&hq_v=2357e2f0b3. Accessed Apr. 6, 2011.
Heger. "Roche's 454 Eyes Immune Repertoire Sequencing as Key Application for Long- Read Platform". Feb. 2, 2010. 4 pages. http://www.genomeweb.com/print/932624.
Henegariu, O. et al., "Multiplex PCR: Critical Parameters and Step-By-Step Protocol," Biotechniques, Informa HealthCare, 23(3):504-511 (1997).
Hensel et al. "Simultaneous identification of bacterial virulence genes by negative selection", Science, 269(5222): 400-403 (1995).
Hill, et al. "Using ecological diversity measures with bacterial communities", FEMS Microbiol Ecol., 43(1):1-11 (2003). doi: 10.1111/j.1574-6941.2003.tb01040.x.
Hirohata, et al. "Regulation of human B cell function by sulfasalazine and its metabolites", Int Immunopharmacol., 2(5): 631-640, Abstract Only (2002).
Hodges, E. et al. "Diagnostic role of tests for T cell receptor (TCR) genes", J Clin Pathol., 56(1): 1-11 (2003).
Holder and Lewis. "Phylogeny estimation: traditional and bayesian approaches", Nat Rev Genet., 4(4): 275-84 (2009).
Holt. "Q &A: BC cancer agency's Robert Holt on sequencing the immune repertoire in immune reconstitution," Genome Web (www.genomeweb.com) Jun. 30, 2009.
Holt and Jones. "The new paradigm of flow cell sequencing", Genome Research, 18:839-846 (2008).
Hoogenboom, et al. "Multi-subunit proteins on the surface of filamentous phage: methodologies for displaying antibody (Fab) heavy and light chains", Nucleic Acids Res., 19(15): 4133-4137 (1991).
Hoogendoorn, et al. "Primary allogeneic T-cell responses against mantle cell lymphoma antigen-presenting cells for adoptive immunotherapy after stem cell transplantation", Clin Cancer Res., 11(14): 5310-5318 (2005).
Hoos, et al. "Improved endpoints for cancer immunotherapy trials", J Natl Cancer Inst., 102(18): 1388-1397 (2010). doi: 10.1093/jnci/djq310. Epub Sep. 8, 2010.
Hoover and Lubkowski. "DNAWorks: an automated method for designing oligonucleotides for PCR-based gene synthesis", Nucleic Acids Res., 30(10): e43, 7 pages (2002).
Hosono, et al. "Unbiased whole-genome amplification directly from clinical samples", Genome Res., 13(5): 954-964 (2003). Epub Apr. 14, 2003.
Hoven, et al. "Detection and isolation of antigen-specific B cells by the fluorescence activated cell sorter (FACS)", J Immunol Methods, 117(2): 275-284, Abstract Only, 2 pages (1989).
Howe, et al. "T cell receptor clonotype analysis of T cell responses: Diagnostic application of a clonotypic database", Blood, 102:Abstract 3918 (2003).
Huang, et al. "Isolation of cell-free DNA from maternal plasma using manual and automated systems", Methods Mol Biol., 444: 203-208, Abstract Only (2008). doi: 10.1007/978-1-59745-066-9_15.
Huh, et al. "Microfluidics for flow cytometric analysis of cells and particles", Physiol Meas., 26(3): R73-98, Abstract Only (2005). Epub Feb. 1, 2005.
Huijsmans, et al. "Comparative analysis of four methods to extract DNA from paraffin-embedded tissues: effect on downstream molecular applications", BMC Res Notes, 3:239, 9 pages (2010). doi: 10.1186/17560500-3-239.
Huse, et al. "Generation of a large combinatorial library of the immunoglobulin repertoire in phage lambda", Science, 246(4935): 1275-1281, Abstract Only (1989).
Huse et al. "Accuracy and quality of massively parallel DNA pyrosequencing", Genome Biology, 8: R143 (2007).
Hwang, H.Y. et al. "Identification of a Commonly used CDR3 Region of Infiltrating T Cells Expressing Vβ13 and Vβ15 Derived from Psoriasis Patients", The Journal of Investigative Dermatology, 120(3):359-364 (2003).
Iancu, et al. "Profile of a serial killer: cellular and molecular approaches to study individual cytotoxic T-cells following therapeutic vaccination", J Biomed Biotechnol., 2011: 452606 (2011). doi: 10.1155/2011/452606. Epub Nov. 14, 2010.
Ilakovac, V., "Statistical hypothesis testing and some pitfalls." Biochemia Medica (2009); 19(1): 10-16, 4 pages. [online]. [Retrieved on Apr. 12, 2016]. Retrieved from the Internet: <URL:http://www.biochemia-medica.com/contentIstatistical-hypothesis-testing-and-some-pitfalls>PDF.
Illumina. Genome analyzer pipeline software version 1.0 user guide. Part #1004759, 176 pages (2008).
Illumina. Data Sheet: Sequencing. Genomic Sequencing. Pub. No. 770.2008-016 Reference states: "Current as of Jan. 30, 2009", 6 pages, Copyright 2010.
Illumina. Data Sheet, "TruSeq™ exome enrichment kit", 5 pages (2011).
Illumina Systems & Software, Technology Spotlight, DNA Sequencing with Solexa® Technology, Illumina, Inc., Pub. No. 770-2007-002, 4 pages (2007).
Illumina. "Technical Note: Systems and Software. Calling sequencing SNPs", 3 pages (2010).
Illumina. TruSeq Sample Preparation Kit and Data Sheet. Illumina, Inc., San Diego, CA, 4 pages (2011).
Ishii et al. "Isolation and expression profiling of genes upregulated in the peripheral blood cells of systemic lupus erythematosus patients," DNA Research, 12:429-439 (2005).
Jabara et al. "Accurate sampling and deep sequencing of the HIV-1 protease gene using a Primer ID", PNAS, 108(50): 20166-20171 (2011).
Jacobi et al. "Activated memory B cell subsets correlate with disease activity in systemic lupus erythematosus: delineation by expression of CD27, IgD, and CD95", Arthritis & Rheumatism, 58(6):1762-1773 (2008).
Jacobi et al. "Correlation between circulating $CD27^{high}$ plasma cells and disease activity in patients with systemic lupus erythematosus" Arthritis & Rheumatism, 48(5):1332-1342 (2003).
Jaffe, et al. "Classification of lymphoid neoplasms: the microscope as a tool for disease discovery", Blood, 112(12): 4384-4399 (2008). doi: 10.1182/blood-2008-07-077992.
Jalla, et al. "Enumeration of lymphocyte subsets using flow cytometry: Effect of storage before and after staining in a developing country setting", Indian J Clin Biochem., 19(2): 95-99 (2004). doi: 10.1007/BF02894264.
Jena, et al. "Amplification of genes, single transcripts and cDNA libraries from one cell and direct sequence analysis of amplified products derived from one molecule", J. Immunol. Methods, 190:199-213 (1996).

(56) References Cited

OTHER PUBLICATIONS

Jochems and Schlom. "Tumor-infiltrating immune cells and prognosis: the potential link between conventional cancer therapy and immunity", *Exp Biol Med* (Maywood), 236(5): 567-579 (2011). doi: 10.1258/ebm.2011.011007. Epub Apr. 12, 2011.
Jones, et al. "Human autoimmunity after lymphocyte depletion is caused by homeostatic T -cell proliferation", Proc Natl Acad Sci USA, 110(50) :20200-5 (2013). doi: 10.1073/pnas.1313654110. Epub Nov. 26, 2013.
Jung, et al. "Unraveling V(D)J recombination; insights into gene regulation", *Cell*, 116(2): 299-311 (2004).
Jurkat, Clone 6-1 (ATCC TIB-152) Webpage retrievable from the ATCC under http://www.lgcstandards-atcc.org/Products/All MB-152. aspx#characteristics. Accessed Oct. 14, 2014.
Kalinina, O. et al. "Nanoliter scale PCR with TaqMan detection", *Nucleic Acids Research*, 25(10):1999-2004 (1997).
Kalos, M. et al. "T Cells with Chimeric Antigen Receptors Have Potent Antitumor Effects and Can Establish Memory in Patients with Advanced Leukemia", *Science Translational Medicine*, 3(95ra73): 1-11 (2011).
Kanda, et al. "Immune recovery in adult patients after myeloablative dual umbilical cord blood, matched sibling, and matched unrelated donor hematopoietic cell transplantation", Biol Blood Marrow Transplant, 18(11):1664-1676 (2012). doi: 10.1016/j.bbmt. 2012.06.005. Epub Jun. 12, 2012.
Kaplinski and Remm. "MultiPLX Automatic Grouping and Evaluation of PCR Primers", *Methods in Molecular Biology*, 402(PCR Primer Design):287-303 (2004).
Kato et al. "Analysis of accumulated T cell clonotypes in patients with systemic lupus erythematosus," *Arthritis & Rheumatism*, 43(12):2712-2721 (2000).
Katz, S.C. et al. "T Cell Infiltrate Predicts Long-Term Survival Following Resection of Colorectal Cancer Liver Metastases," Ann. Surg. Oncol., 16:2524-2530 (2009).
Kedzierska, et al. "Tracking phenotypically and functionally distinct T cell subsets via T cell repertoire diversity", *Mol Immunol.*, 45(3): 607-618 (2008). Epub Aug. 24, 2007.
Kehrl, J.H. et al. "Chemoattractant Receptor Signaling and Its Role in Lymphocyte Motility and Trafficking", *Current Topics in Microbiology and Immunology*, 334:107-127 (2009).
Kiianitsa, et al., "Development of Tools for T-Cell Repertoire Analysis (TCRB Spectratyping) for the Canine Model of Hematopoietic Cell Transplantation", *Blood*, ASH—Annual Meeting Abstracts, 110:Abstract 4873, 2 pages (2007).
Kim, et al. "An efficient and reliable DNA extraction method for preimplantation genetic diagnosis: a comparison of allele drop out and amplification rates using different single cell lysis methods", *Fertility and Sterility*, 92: 814-818 (2009).
Kim, et al. "Polony multiplex analysis of gene expression (PMAGE) in mouse hypertrophic cardiomyopathy", *Science*, 316(5830):1481-1484 (2007).
Kinde et al. "Detection and quantification of rare mutations with massively parallel sequencing," *PNAS*, 108(23): 9530-9535 and Supporting Information, 16 pages (2011).
Kircher, et al. "Improved base calling for the Illumina Genome Analyzer using machine learning strategies", *Genome Biol.*, 10(8): R83, 9 pages (2009). doi: 10.1186/gb-2009-10-8-r83. Epub Aug. 14, 2009.
Kirsch, et al. "Defining immunoglobulin somatic hypermutation in de novo diffuse large b-cell lymphoma patients: potential application prognosis and risk stratification", Presented for the 2014 ASH Annual Meeting. Poster. 1 page. Dec. 5-9, 2014.
Kirsch, et al. "High-throughput TCR sequencing provides added value in the diagnosis of cutaneous T-cell lymphoma", Presented for the 2014 ASH Annual meeting. Poster. 1 page. Dec. 5-9, 2014.
Kita, et al. "T cell receptor clonotypes in skin lesions from patients with systemic lupus erythematosus", *Journal of Investigative Dermatology*,110(1): 41-6 (1988).
Kivioja et al. "Counting absolute numbers of molecules using unique molecular identifiers," *Nature Methods*, 9(1): 72-76 (2012).

Klarenbeek, P.L. et al. "Deep sequencing of antiviral T-cell responses to HCMV and EBV in humans reveals a stable repertoire that is maintained for many years." PLoS Pathogens (2012); 8.9: e1002889.
Klarenbeek, P.L. et al. "Human T-cell memory consists mainly of unexpanded clones", *Immunology Letters*, 133: 42-48 (2010).
Klinger et al. "Combining next-generation sequencing and immune assays: a novel method for identification of antigen-specific T cells", PLoS One, 8(9): e74231, 1-9 (2013).
Klebanoff, et al. "Therapeutic cancer vaccines: are we there yet?", *Immunol Rev.*, 239(1): 27-44 (2011). doi: 10.1111/j.1600-065X. 2010.00979.x.
Klenerman, et al. "Tracking T cells with tetramers: new tales from new tools", *Nat Rev Immunol.*, 2(4):263-272 (2002).
Kneba, M., et al. "Analysis of Rearranged T-cell Receptor β-Chain Genes by Polymerase Chain Reaction (PCR) DNA Sequencing and Automated High Resolution PCR Fragment Analysis", *Blood*, 86:3930-3937 (1995).
Kneba, et al. "Characterization of clone-specific rearrangement T-cell receptor gamma-chain genes in lymphomas and leukemias by the polymerase chain reaction and DNA sequencing", *Blood*, 84(2):574-581 (1994).
Kobari, et al. "T cells accumulating in the inflamed joints of a spontaneous murine model of rheumatoid arthritis become restricted to common clonotypes during disease progression", *Int Immunol.*, 16(1):131-138 (2004).
Koboldt et al., "VarScan: variant detection in massively parallel sequencing of individual and pooled samples", Bioinformatics, 25(17): 2283-2285 (2009).
Koch, et al. "Tumor infiltrating T lymphocytes in colorectal cancer: Tumor-selective activation and cytotoxic activity in situ," *Ann Surg.*, 244(6): 986-992; discussion 992-993 (2006).
Kojima et al. "PCR amplification from single DNA molecules on magnetic beads in emulsion: application for high-throughput screening of transcription factor targets", *Nucleic Acids Research*, 33: 17, e150, 9 pages (2005).
Kohlmann, et al. "Integration of next-generation sequencing into clinical practice: are we there yet?", *Semin Oncol.*, 39(1): 26-36, Abstract Only (2012). doi: 10.1053/j.seminoncol.2011.11.008.
Kou, et al. "T-Cell receptor Vbeta repertoire CDR3 length diversity differs within CD45RA and CD45R0 T-cell subsets in healthy and human immunodeficiency virus-infected children", *Clin Diagn Lab Immunol.*, 7(6):953-9 (2000).
Krause et al. "Epitope-Specific Human Influenza Antibody Repertoires Diversify by B Cell Intraclonal Sequence Divergence and Interclonal Convergence", *The Journal of Immunology*, 187: 3704-3711 (2011).
Krueger, et al. "Large scale loss of data in low-diversity illumina sequencing libraries can be recovered by deferred cluster calling", *PLoS One*, 6(1): e16607, 7 pages (2011). doi: 10.1371/journal.pone. 0016607.
Ku, et al. "Exome sequencing: dual role as a discovery and diagnostic tool", *Ann Neurol.*, 71(1):5-14, Abstract Only (2012). doi: 10.1002/ana.22647.
Kumar, et al. "PEG-labeled nucleotides and nanopore detection for single molecule DNA sequencing by synthesis", *Sci Rep.*, 2:684, 8 pages (2012). Epub Sep. 21, 2012.
Kwak, et al. "Induction of immune responses in patients with B-cell lymphoma against the surface-immunoglobulin idiotype expressed by their tumors", *N Engl J Med.*, 327(17):1209-1215 (1992).
Kyu et al. "Frequencies of human influenza-specific antibody secreting cells or plasmablasts post vaccination from fresh and frozen peripheral blood mononuclear cells", *Journal of Immunological Methods*, 340: 42-47 (2009).
Ladányi, A., et al. "Prognostic impact of B-cell density in cutaneous melanoma", *Cancer Immunol. Immunother.*, 60(12): 1729-1738 (2011).
Ladetto, et al., "Next-generation sequencing and real-time quantitative PCR for minimal residual disease (MRD) detection using the immunoglobulin heavy chain variable region: a methodical comparison in acute lymphoblastic leukemia (ALL), mantle cell lymphoma (MCL) and multiple myeloma (MM)", *Blood*, vol. 120, No. 21, Abstract 788 (Conference Abstract), Entire Abstract (2012).

(56) References Cited

OTHER PUBLICATIONS

Ladetto, M. et al. "Real-time polymerase chain reaction in multiple myeloma: Quantitative analysis of tumor contamination of stem cell harvests", *Experimental Hematology*, 30:529-536 (2002).

Ladetto, M. et al. "Real-Time Polymerase Chain Reaction of Immunoglobulin Rearrangements for Quantitative Evaluation of Minimal Residual Disease in Multiple Myeloma", *American Society for Blood and Marrow Transplantation*, 6(3):241-253 (2000).

Landwehr-Kenzel, et al. "Novel GMP-compatible protocol employing an allogeneic B cell bank for clonal expansion of allospecific natural regulatory T cells", Am J Transplant., 14(3):594-606 (2014). doi: 10.1111/ajt.12629. Epub Jan. 27, 2014.

Langerak, et al. "Immunoglobulin/T-cell receptor clonality diagnostics", *Expert Opin. Med. Diagn.*, 1(3):451-461 (2007).

Langerak, et al. "Polymerase chain reaction-based clonality testing in tissue samples with reactive lymphoproliferations: usefulness and pitfalls. A report of the BIOMED-2 Concerted Action BMH4-CT98-3936", *Leukemia*, 21(2):222-229 (2007).

Laplaud et al. "Blood T-cell receptor β chain transcriptome in multiple sclerosis. Characterization of the T cells with altered CDR3 length distribution", *Brain*, 127:981-995 (2004).

Laplaud et al. "Serial blood T cell repertoire alterations in multiple sclerosis patients; correlation with clinical and MRI parameters", *Journal of Neuroimmunology*, 177(1-2):151-160 (2006).

Larimore, K., et al. "Shaping of Human Germline IgH Repertoires Revealed by Deep Sequencing", *The Journal of Immunology*, 189(6): 3221-3230 (2012).

Lassmann, et al. "Application of BIOMED-2 primers in fixed and decalcified bone marrow biopsies: analysis of immunoglobulin H receptor rearrangements in B-cell non-Hodgkin's lymphomas", *J Mol Diagn.*, 7(5): 582-591 (2005).

Lazareva-Ulitsky et al, "On the quality of tree-based protein classification," Bioinformatics, 21(9): 1876-1890 (2005).

Lee, et al. "Characterization of circulating T cells specific for tumor-associated antigens in melanoma patients", *Nat Med.*, 5(6): 677-685, Abstract Only (1999).

Lee, et al. "Prognostic implications of type and density of tumour-infiltrating lymphocytes in gastric cancer", *Br J Cancer*, 99(10): 1704-1711 (2008). doi: 10.1038/sj.bjc.6604738. Epub Oct. 21, 2008.

Lefranc. "IMGT, the international ImMunoGeneTics database", *Nucleic Acids Res.*, 31(1):307-310 (2003).

Leiden, J.M. et al. "The Complete Primary Structure of the T-Cell Receptor Genes From an Alloreactive Cytotoxic Human T-Lymphocyte Clone", Immunogenetics, 24(1): 17-23 (1986).

Leisner, et al. "One-pot, mix-and-read peptide-MHC tetramers", *PLoS One*, 3(2):e1678, 11 pages (2008). doi: 10.1371/journal.pone.0001678.

Lennon, et al. "A scalable, fully automated process for construction of sequence-ready barcoded libraries for 454", *Genome Biol.*, 11(2):R15, 9 pages (2010). doi: 10.1186/gb-2010-11-2-r15. Epub Feb. 5, 2010.

Leary, et al. "Development of personalized tumor biomarkers using massively parallel sequencing", Sci Transl Med., 2(20): 20ra14 (2010). doi: 10.1126/scitranslmed.3000702.

Leone, et al. "Molecular beacon probes combined with amplification by NASBA enable homogeneous, real-time detection of RNA", *Nucleic Acids Research*, 26(9): 2150-2155 (1998).

Leproust, et al. "Synthesis of high-quality libraries of long (150mer) oligonucleotides by a novel depurination controlled process", *Nucleic Acids Res.*, 38(8): 2522-2540 (2010). doi: 10.1093/nar/gkq163. Epub Mar. 22, 2010.

Lessin, et al. "Molecular diagnosis of cutaneous T-cell lymphoma: polymerase chain reaction amplification of T-cell antigen receptor beta-chain gene rearrangements", *J Invest Dermatol.*, 96(3): 299-302 (1991).

Li, et al. "Utilization of Ig heavy chain variable, diversity, and joining gene segments in children with B-lineage acute lymphoblastic leukemia: implications for the mechanisms of VDJ recombination and for pathogenesis", *Blood*, 103(12):4602-4609 (2004).

Li, et al. "An improved one-tube RT-PCR protocol for analyzing single-cell gene expression in individual mammalian cells", *Anal. Bioanal. Chem.*, 397: 1853-1859 (2010).

Li, et al. "β cell-specific CD4+ T cell clonotypes in peripheral blood and the pancreatic islets are distinct", *J Immunol.*, 183(11): 7585-7591 (2009). doi: 10.4049/jimmunol.0901587. Epub Nov. 16, 2009.

Li, et al. "Clonal rearrangements in childhood and adult precursor B acute lymphoblastic leukemia: a comparative polymerase chain reaction study using multiple sets of primers", *Eur J Haematol.*, 63(4):211-218 (1999).

Li, et al. "Detailed clonality analysis of relapsing precursor B acute lymphoblastic leukemia: implications for minimal residual disease detection", *Leukemia Research*, 25:1033-1045 (2001).

Li et al, "Mapping short DNA sequencing reads and calling variants using mapping quality scores," Genome Research, 18: 1851-1858 (2008).

Li, et al. "Sequence analysis of clonal immunoglobulin and T-cell receptor gene rearrangements in children with acute lymphoblastic leukemia at diagnosis and at relapse: implications for pathogenesis and for the clinical utility of PCR-based methods of minimal residual disease detection", *Blood*, 102:4520-4526 (2003).

Liedtke, et al. "A comparison of methods for RNA extraction from lymphocytes for RT-PCR", *PCR Methods and Applications*, 4(3): 185-187 (1994).

Lin, et al. "Multiplex genotype determination at a large number of gene loci", *Proc Natl Acad Sci USA*, 93(6): 2582-2587 (1996).

Liu, et al. "CD127 expression inversely correlates with FoxP3 and suppressive function of human CD4+ T reg cells", *J Exp Med.*, 203(7): 1701-1711 (2006). Epub Jul. 3, 2006.

Lo, et al. "T cell immunodominance is dictated by the positively selecting self-peptide", Elife, 3:e01457 (2014). doi: 10.7554/eLife.01457. Epub Jan. 14, 2014.

Logan, et al., "High-throughput immunoglobulin gene sequencing quantifies minimal residual disease in CLL with 10e-6 sensitivity and strongly predicts relapse after allogeneic hematopoietic cell transplantation", *Blood*, vol. 118 (21), Abstract 2542 (2011).

Logan, A.C. et al. "High-throughput VDJ sequencing for quantification of minimal residual disease in chronic lymphocytic leukemia and immune reconstitution assessment", *PNAS*, 108(52): 21194-21199 (2011). Epub Dec. 12, 2011.

Logan, et al., "Massively parallel immunoglobulin gene sequencing provides ultra-sensitive minimal residual disease detection and predicts post-transplant relapse in acute lymphoblastic leukemia by three to six months", *Blood*, vol. 118 (21), Abstract 4104 (2011).

Lossos, et al. "Transformation of follicular lymphoma to diffuse large-cell lymphoma: alternative patterns with increased or decreased expression of c-myc and its regulated genes", *PNAS*, 99(13): 8886-8891 (2002).

Lovisa, et al. "IGH and IGK gene rearrangements as PCR targets for pediatric Burkitt's lymphoma and mature B-ALL MRD analysis", *Lab Invest.*, 89(10):1182-1186 (2009).

Lowe, T., et al., "A computer program for selection of oligonucleotide primers for polymerase chain reactions," Nucleic Acids Research, 18(7):1757-1761 (1990).

Lowman, et al. "Monovalent phage display: a method for selecting variant proteins from random libraries", *Methods: A Companion to Methods in Enzymology*, 3: 205-216, Abstract Only (1991).

Lúcio, P. et al. "Flow cytometric analysis of normal B cell differentiation: a frame of reference for the detection of minimal residual disease in precursor-B-ALL", *Leukemia*, 13:419-427 (1999).

Lyamichev, et al. "Polymorphism identification and quantitative detection of genomic DNA by invasive cleavage of oligonucleotide probes", *Nat Biotechnol.*, 17(3): 292-396 (1999).

Luo et al. "Analysis of the interindividual conservation of T cell receptor α- and β-chain variable regions gene in the peripheral blood of patients with systemic lupus erythematosus", *Clinical & Experimental Immunology*, 154(3):316-324 (2008).

Mackay, et al. "Real-time PCR in virology", *Nucleic Acids Res.*, 30(6): 1292-305 (2002).

Mahmoud, S.M.A. et al. "Tumor-Infiltrating CD8+ Lymphocytes Predict Clinical Outcome in Breast Cancer", Journal of Clinical Oncology, 29(15): 1949-1955 (2011).

(56) References Cited

OTHER PUBLICATIONS

Maldonado, et al. "Intramuscular therapeutic vaccination targeting HPV16 induces T cell responses that localize in mucosal lesions", Sci Transl Med., 6(221): 221ra13 (2014). doi: 10.1126/scitranslmed.3007323.
Malyguine, et al. "ELISPOT Assay for Monitoring Cytotoxic T Lymphocytes (CTL) Activity in Cancer Vaccine Clinical Trials", *Cells*, 1(2): 111-126 (2012). doi: 10.3390/cells1020111.
Manion et al., "Reducing Error in Next Generation Sequencing Data with NextGENe Software's Condensation Tool™", Mar. 2009, pp. 1-3. XP055226038.
Manrao, et al. "Reading DNA at single-nucleotide resolution with a mutant MspA nanopore and phi29 DNA polymerase", *Nat Biotechnol.*, 30(4): 349-353 (2012). doi: 10.1038/nbt.2171.
Mar et al. "Inferring steady state single-cell gene expression distributions from analysis of mesoscopic samples", *Genome Biology*, 7(12): R119, 12 pages (2006).
Mardis. "Next-generation DNA sequencing methods", *Annu. Rev. Genomics Hum. Genet.*, 9:387-402 (2008). doi: 10.1146/annurev.genom.9.081307.164359.
Marelli-Berg, F.M., et al. "Memory T-cell trafficking: new directions for busy commuters", *Immunology*, 130:158-165 (2010).
Margulies, et al. "Genome sequencing in microfabricated high-density picolitre reactors", *Nature*, 437(7057):376-380 (2005). Epub Jul. 31, 2005.
Mariani, S. et al., "Comprehensive assessment of the TCRBV repertoire in small T-cell samples by means of an improved and convenient multiplex PCR method," *Experimental Hematology*, 37(6):728-738 (2009).
Markoulatos, P. et al., "Multiplex Polymerase Chain Reaction: A Practical Approach", Journal of Clinical Laboratory Analysis, 16:47-51 (2002).
Marrero, et al. "High-throughput sequencing of islet-infiltrating memory CD4+ T cells reveals a similar pattern of TCR Vβ usage in prediabetic and diabetic NOD mice", PLoS One, 8(10):e76546 (2013). doi: 10.1371/journal.pone.0076546. eCollection 2013.
Martin-Jimenez, et al. "Molecular characterization of heavy chain immunoglobulin gene rearrangements in Waldenström's macroglobulinemia and IgM monoclonal gammopathy of undetermined significance", *Haematologica*, 92(5): 635-642 (2007).
Mary et al. "Analysis of gene expression at the single-cell level using microdroplet-based microfluidic technology", *Biomicrofluidics*, 5: 024109-1-024109-10 (2011).
Maryanski, J.L. et al., "A quantitative, single-cell PCR analysis of an antigen-specific TCR repertoire 8 selected during an in vivo CD8 response: direct evidence for a wide range of clone sizes with uniform tissue distribution", Molecular Immunology, 36:745-753 (1999).
Maślanka, K. et al., "Molecular Analysis of T-Cell Repertoires: Spectratypes Generated by Multiplex Polymerase Chain Reaction and Evaluated by Radioactivity or Fluorescence", *Human Technology*, 44(1):28-34 (1995).
Mato et al. "Correlation of clonal T cell expansion with disease activity in systemic lupus erythematosus", *Int Immunol.*, 9(4):547-554 (1997).
Matolcsy, et al. "Clonal evolution of B cells in transformation from low- to high-grade lymphoma", *Eur. J. Immunol.*, 29(4):1253-1264 (1999).
Matsubara, et al. "Microchamber array based DNA quantification and specific sequence detection from a single copy via PCR in nanoliter volumes", *Biosens Bioelectron*, 20(8): 1482-1490, Abstract Only (2005).
Matsumoto et al. "CDR3 spectratyping analysis of the TCR repertoire in Myasthenia Gravis", *The Journal of Immunology*, 176:5100-5107 (2006).
Matsumoto et al. "Complementarity-determining region 3 spectratyping analysis of the TCR repertoire in multiple sclerosis", *The Journal of Immunology*, 170:4846-4853 (2003).

Mazor et al. "Antibody internalization studied using a novel IgG binding toxin fusion", *Journal of Immunological Methods*, 321: 41-59 (2007).
Mazumder, et al., "Detection of multiple myeloma cells in peripheral blood using high-throughput sequencing assay" *Blood*, vol. 120, No. 21, Abstract 321 (Conference Abstract), Entire Abstract (2012).
McCloskey et al. "Encoding PCR products with batch-stamps and barcodes," *Biochem. Genet.*, 45: 761-767 (2007).
McGoldrick, et al. "Cytomegalovirus-specific T cells are primed early after cord blood transplant but fail to control virus in vivo", Blood, 121(14): 2796-803 (2013). doi: 10.1182/blood-2012-09-453720. Epub Feb. 14, 2013.
McLean et al. "Recognition of human cytomegalovirus by human primary immunoglobulins identifies an innate foundation to an adaptive immune response", J. Immunol., 174(8): 4768-4778 (2005).
Mei et al. "Blood-borne human plasma cells in steady state are derived from mucosal immune responses", *Blood*, 113(11): 2461-2469 (2009).
Meijer et al. "Isolation of Human Antibody Repertoires with Preservation of the Natural Heavy and Light Chain Pairing", *J. Mol. Biol.*, 358: 764-772 (2006).
Meier, et al. "Fractal organization of the human T cell repertoire in health and after stem cell transplantation", Biol Blood Marrow Transplant., 19(3):366-77 (2013). doi: 10.1016/j.bbmt.2012.12.004. Epub Jan. 11, 2013.
Meier et al. "Simultaneous evaluation of T-cell and B-cell clonality, t(11;14) and t(14;18), in a single reaction by a four-color multiplex polymerase chain reaction assay and automated High-Resolution fragment analysis", *American Journal of Pathology*, 159(6): 2031-2043 (2001).
Meier, et al. "The influence of different stimulation conditions on the assessment of antigen-induced CD154 expression on CD4+ T cells", *Cytometry A.*, (11):1035-1042 (2008). doi: 10.1002/cyto.a.20640.
Meleshko, et al. "Rearrangements of IgH, TCRD and TCRG genes as clonality marker of childhood acute lymphoblastic leukemia", *Experimental Oncology*, 27(4):319-324 (2005).
Menezes et al. "A public T cell clonotype within a heterogeneous autoreactive repertoire is dominant in driving EAE", *J Clin Invest*, 117(8):2176-2185 (2007).
Merriam-Webster, 2 pages, (definition of "e.g.," accessed Apr. 25, 2014).
Merriam-Webster, 4 pages (definition of "substantial," accessed Apr. 25, 2014).
Metzker, "Sequencing Technologies—The Next Generation", *Nature Reviews*, Genetics, 11:31-46 (2010).
Meyer et al. "Targeted high-throughput sequencing of tagged nucleic acid samples", *Nucleic Acids Research*, 35(15): e97, 5 pages (2007).
Miceli and Parnes. "The roles of CD4 and CD8 in T cell activation", *Seminars in Immunology*, 3(3): 133-141 (1991). Abstract only.
Michálek, et al. "Detection and long-term in vivo monitoring of individual tumor-specific T cell clones in patients with metastatic melanoma", *J Immunol.*, 178(11):6789-6795 (2007).
Michálek, et al. "Identification and monitoring of graft-versus-host specific T-cell clone in stem cell transplantation", *The Lancet*, 361(9364): 1183-1185 (2003).
Miller, et al., "Assembly algorithms for next-generation sequencing data", Genomics, 95(6): 315-327 (2010).
Miltenyi, et al. "High gradient magnetic cell separation with MACS", *Cytometry*, 11(2): 231-238 (1990).
Miner et al. "Molecular barcodes detect redundancy and contamination in hairpin-bisulfite PCR", *Nucleic Acids Research*, 32(17): e135, 4 pages (2004).
Miqueu, P. et al. "Statistical analysis of CDR3 length distributions for the assessment of T and B cell repertoire biases", *Molecular Immunology*, 44:1057-1064 (2007).
Mitra, et al. "Fluorescent in situ sequencing on polymerase colonies", *Anal Biochem.*, 320(1): 55-65, Abstract Only (2003).
Mittelstadt, et al. "Thymocyte responsiveness to endogenous glucocorticoids is required for immunological fitness", J Clin Invest., 122(7):2384-94 (2012). doi: 10.1172/JCI63067. Epub Jun. 1, 2012.

(56) References Cited

OTHER PUBLICATIONS

Miyashita, et al. "N-Methyl substituted 2',4'-BNANC: a highly nuclease-resistant nucleic acid analogue with high-affinity RNA selective hybridization", Chem Commun (Camb), (36): 3765-3767, Abstract Only (2007). Epub Jul. 9, 2007.

Moen, et al. "Immunoglobulin G and A antibody responses to Bacteroides forsyth and Prevotella intermedia in sera and synovial fluids of arthritis patients", Clin Diagn Lab Immunol., 10(6): 1043-1050 (2003).

Molloy, et al. "Soluble T cell receptors: novel immunotherapies", Curr Opin Pharmacol., 5(4): 438-443 (2005) (Abstract Only).

Monod, M.Y. et al. "IMGT/JunctionAnalysis: the first tool for the analysis of the immunoglobulin and T cell receptor complex V-J and V-D-J JUNCTIONs", Bioinformatics, 20(Suppl 1):i379-385 (2004).

Moody, et al. "Antigen-specific B cell detection reagents: use and quality control", Cytometry A., 73(11): 1086-1092 (2008). doi: 10.1002/cyto.a.20599.

Morgan, et al. "Cancer regression in patients after transfer of genetically engineered lymphocytes", Science, 314(5796): 126-129 (2006). Epub Aug. 31, 2006.

Morozova et al. "Applications of New Sequencing Technologies for Transcriptome Analysis", Annu. Rev. Genomics Hum. Genet., 10: 135-151 (2009).

Morrissy et al. "Next-generation tag sequencing for cancer gene expression profiling", Genome Research, 19: 1825-1835 (2009).

Moss, et al. "The human T cell receptor in health and disease", Annu. Rev. Immunol., 10:71-96 (1992).

Moura, et al. "Alterations on peripheral blood B-cell subpopulations in very early arthritis patients", Rheumatology (Oxford), 49(6): 1082-1092 (2010). doi: 10.1093/rheumatology/keq029. Epub Mar. 7, 2010.

Mueller, et al. "Human Treg responses allow sustained recombinant adeno-associated virus-mediated transgene expression", J Clin Invest., 123(12): 5310-8 (2013). doi: 10.1172/JCI70314. Epub Nov. 15, 2013.

Muraro et al. "Molecular tracking of antigen-specific T cell clones in neurological immune-mediated disorders", Brain, 126(Pt 1):20-31 (2003).

Muraro, et al. "T cell repertoire following autologous stem cell transplantation for multiple sclerosis", J Clin Invest., 124(3): 1168-72 (2014). doi: 10.1172/JCI71691. Epub Feb. 17, 2014.

Murugan, et al. "Statistical inference of the generation probability of T-cell receptors from sequence repertoires", PNAS, 109(40): 16161-16166 (2012). doi: 10.1073/pnas.1212755109. Epub Sep. 17, 2012.

Naito, et al. "CD8+ T cells infiltrated within cancer cell nests as a prognostic factor in human colorectal cancer", Cancer Research, 58(16): 3491-3494 (1998).

Nakano, et al. "Single-molecule PCR using water-in-oil emulsion", J Biotechnol., 102(2): 117-124, Abstract Only (2003).

Nardi, et al. "Quantitative monitoring by polymerase colony assay of known mutations resistant to ABL kinase inhibitors", Oncogene, 27(6):775-782 (2008). Epub Aug. 6, 2007, 1-8.

Navarrete, et al. "Upfront immunization with autologous recombinant idiotype Fab fragment without prior cytoreduction in indolent B-cell lymphoma", Blood, 117(5): 1483-1491 (2011). doi: 10.1182/blood-2010-06-292342. Epub Nov. 2, 2010.

Neale, et al. "Comparative analysis of flow cytometry and polymerase chain reaction for the detection of minimal residual disease in childhood acute lymphoblastic leukemia", Leukemia, 18(5):934-938 (2004).

Needleman and Wunsch. "A general method applicable to the search for similarities in the amino acid sequence of two proteins", J Mol Biol., 48(3): 443-453 (1970).

Neller, et al. "High frequency of herpesvirus-specific clonotypes in the human T cell repertoire can remain stable over decades with minimal turnover", J Virol., 87(1): 697-700 (2013). doi: 10.1128/NI.02180-12. Epub Oct. 17, 2012.

Nelson. "CD20+ B cells: the other tumor-infiltrating lymphocytes", The Journal of Immunology, 185(9): 4977-4982 (2010). doi: 10.4049/jimmunol.1001323.

Newman, et al. "Identification of an antigen-specific B cell population", J Immunol Methods, 272(1-2): 177187, Abstract Only (2003).

Nguyen et al. "Identification of errors introduced during high throughput sequencing of the T cell receptor repertoire" BMC Genomics, 12: 106, 13 pages (2011).

Nicot, N. et al. "Housekeeping gene selection for real-time RT-PCR normalization in potato during biotic and abiotic stress", Journal of Experimental Botany, 56(421):2907-2914 (2005).

Nie, et al. "Optical detection of single molecules", Annu. Rev. Biophys. Biomol. Struct., 26: 567-596 (1997).

Nielsen, et al. "Peptide nucleic acid (PNA). A DNA mimic with a pseudopeptide backbone", Chem. Soc. Rev., 26:73-78, Abstract Only (1997).

Nolan, T. et al. "Quantification of mRNA using real-time RT-PCR", Nature Protocols, 1(3):1559-1582 (2006).

Nosho, et al. "Tumour-infiltrating T-cell subsets, molecular changes in colorectal cancer, and prognosis: cohort study and literature review", J Pathol., 222(4): 350-366 (2010). doi: 10.1002/path.2774.

Novak, et al. "Single Cell Multiplex Gene Detection and Sequencing Using Microfluidically-Generated Agarose Emulsions", Angew Chem Int Ed Engl., 50(2): 390-395, with supplemental materials (2011).

Nucleis product webpage, "Exonuclease I-Shrimp alkaline phosphatase clean up of PCR products," (Published on webpage 2013) Downloaded Dec. 15, 2015.

Oble, et al. "Focus on TILs: prognostic significance of tumor infiltrating lymphocytes in human melanoma", Cancer Immunity, 9: 3, 20 pages (2009).

O'Brian et al., "Sorting out mix-ups. The provenance of tissue sections may be confirmed by PCR using microsatellite markers", Am. J. Clin. Pathol., 106(6): 758-764 (1996). (Abstract Only).

Oelke, et al. "Ex vivo induction and expansion of antigen-specific cytotoxic T cells by HLA-Ig-coated artificial antigen-presenting cells", Nat Med., 9(5): 619-624 (2003). Epub Apr. 21, 2003.

Ogle, et al. "Direct measurement of lymphocyte receptor diversity", Nucleic Acids Research, 31(22):e139, 6 pages (2003).

Ohtani. "Focus on TILs: prognostic significance of tumor infiltrating lymphocytes in human colorectal cancer", Cancer Immunity, 7: 4, 9 pages (2007).

Okajima et al. "Analysis of T cell receptor Vβ diversity in peripheral CD4+ and CD8+ T lymphocytes in patients with autoimmune thyroid diseases", Clinical & Experimental Immunology, 155:166-172 (2008).

Okello et al. "Comparison of methods in the recovery of nucleic acids from archival formalin-fixed paraffin-embedded autopsy tissues", Anal Biochem., 400(1): 110-117 (2010). doi: 10.1016/j.ab.2010.01.014. Epub Jan. 15, 2010.

Ottensmeier, et al. "Analysis of VH genes in follicular and diffuse lymphoma shows ongoing somatic mutation and multiple isotype transcripts in early disease with changes during disease progression", Blood, 91(11): 4292-4299 (1998).

Packer and Muraro. "Optimized clonotypic analysis of T-cell receptor repertoire in immune reconstitution", Experimental Hematology, 35(3):516-521 (2007).

Pagès, Franck. Tumor-associated immune parameters for personalized patient care. Sci Transl Med., 5(214):214fs42 (2013). doi: 10.1126/scitranslmed.3007942.

Palmowski, et al. "The use of HLA class I tetramers to design a vaccination strategy for melanoma patients", Immunol Rev., 188: 155-163 (2002) (Abstract Only).

Palomaki, et al. "DNA sequencing of maternal plasma reliably identifies trisomy 18 and trisomy 13 as well as Down syndrome: an international collaborative study", Genet Med., 14(3): 296-305 (2012). doi: 10.1038/gim.2011.73. Epub Feb. 2, 2012.

Pan, et al. "A new FACS approach isolates hESC derived endoderm using transcription factors", PLoS One, 6(3): e17536, 9 pages (2011). doi: 10.1371/journal.pone.0017536.

Panzer-Grümayer et al. "Immunogenotype changes prevail in relapses of young children with TEL-AML1-positive acute lymphoblastic

(56) References Cited

OTHER PUBLICATIONS leukemia and derive mainly from clonal selection", *Clin Cancer Research*, 11(21):7720-7727 (2005).
Parameswaran et al. "A pyrosequencing-tailored nucleotide barcode design unveils opportunities for large-scale sample multiplexing", *Nucleic Acids Research*, 35(19): e130, 9 pages (2007).
Parmigiani, et al. "Design and analysis issues in genome-wide somatic mutation studies of cancer", *Genomics*, 93(1): 17-21 (2009). doi: 10.1016/j.ygeno.2008.07.005. Epub Aug. 23, 2008.
Pasqual et al. "Quantitative and qualitative changes in V-J alpha rearrangements during mouse thymocytes differentiation: implication for a limited T cell receptor alpha chain repertoire", *Journal of Experimental Medicine*, 196(9): 1163-1173 (2002). XP002322207 ISSN: 0022-1007.
Paszkiewicz et al, "De novo assembly of short sequence reads," *Briefings in Bioinformatics*, 11(5): 457-472 (2010).
Payne, et al. "Peripheral blood mononuclear cells of patients with breast cancer can be reprogrammed to enhance anti-HER-2/neu reactivity and overcome myeloid-derived suppressor cells", Breast Cancer Res Treat., 142(1):45-57 (2013). doi: 10.1007/s10549-013-2733-5. Epub Oct. 25, 2013.
Peet. "The Measurement of Species Diversity", *Annual Review of Ecology and Systematics*, 5: 285-307, Abstract Only (1974).
Petrosino, et al. "Metagenomic pyrosequencing and microbial identification", *Clin Chem.*, 55(5): 856-866 (2009). doi: 10.1373/clinchem. 2008.107565. Epub Mar. 5, 2009.
PCT/US2009/006053, International Search Report dated Jun. 15, 2010, 6 pages.
PCT/US2009/006053, Written Opinion dated Jun. 15, 2010, 4 pages.
PCT/US2009/006053, International Preliminary Report on Patentability dated May 10, 2011, 5 pages.
PCT/US2010/021264, International Search Report and Written Opinion dated Apr. 14, 2010, 7 pages.
PCT/US2010/021264, International Preliminary Report on Patentability dated Jul. 19, 2011, 5 pages.
PCT/US2016/019343, International Search Report and Written Opinion dated Jul. 22, 2016, 23 pages.
PCT/US2010/037477, International Search Report and Written Opinion dated Sep. 24, 2010, 10 pages.
PCT/US2010/037477, International Preliminary Report on Patentability dated Jan. 4, 2012, 7 pages.
PCT/US2011/000791, International Search Report and Written Opinion dated Sep. 22, 2011, 13 pages.
PCT/US2011/000791, International Preliminary Report on Patentability dated Nov. 6, 2012, 10 pages.
PCT/US2011/049012, International Search Report and Written Opinion dated Apr. 10, 2012, 9 pages.
PCT/US2011/049012, International Preliminary Report on Patentability dated Feb. 26, 2013, 5 pages.
PCT/US2013/028942, International Search Report and Written Opinion dated May 9, 2013, 10 pages.
PCT/US2013/028942, International Preliminary Report on Patentability dated May 5, 2015, 9 pages.
PCT/US2013/054189, International Search Report and Written Opinion dated Oct. 21, 2013, 10 pages.
PCT/US2013/054189, International Preliminary Report on Patentability dated Feb. 10, 2015, 7 pages.
PCT/US2013/035857, International Search Report and Written Opinion dated Aug. 7, 2013, 10 pages.
PCT/US2013/035857, International Preliminary Report on Patentability dated Oct. 14, 2014, 8 pages.
PCT/US2013/040221, International Search Report and Written Opinion dated Sep. 23, 2013, 15 pages.
PCT/US2013/040221, International Preliminary Report on Patentability dated Apr. 24, 2014, 41 pages.
PCT/US2013/045276, International Search Report and Written Opinion dated Jan. 29, 2014, 11 pages.
PCT/US2013/045276, International Preliminary Report on Patentability dated Dec. 16, 2014, 2014, 7 pages.
PCT/US2013/045994, International Search Report and Written Opinion dated Oct. 25, 2013, 15 pages.
PCT/US2013/045994, International Preliminary Report on Patentability dated Dec. 16, 2014, 10 pages.
PCT/US2013/051539, International Search Report and Written Opinion dated Nov. 27, 2013, 9 pages.
PCT/US2013/051539, International Preliminary Report on Patentability dated Jan. 27, 2015, 7 pages.
PCT/US2014/030859, International Search Report and Written Opinion dated Jul. 18, 2014, 14 pages.
PCT/US2014/030859, International Preliminary Report on Patentability dated Sep. 15, 2015, 8 pages.
PCT/US2014/044971, International Search Report and Written Opinion dated Oct. 30, 2014, 14 pages.
PCT/US2014/044971, International Preliminary Examination Report dated Jan. 6, 2016, 12 pages.
PCT/US2015/018967, International Search Report and Written Opinion dated Jul. 30, 2015, 17 pages.
PCT/US2015/019029, International Search Report and Written Opinion dated Sep. 15, 2015, 19 pages.
PCT/US2015/019029, International Preliminary Report on Patentability dated Sep. 6, 2016, 14 pages.
PCT/US2015/023915, International Search Report and Written Opinion dated Aug. 26, 2015, 11 pages.
PCT/US2015/023915, International Preliminary Report on Patentability dated Oct. 4, 2016, 7 pages.
PCT/US2015/058035, International Search Report and Written Opinion dated Jan. 29, 2016, 14 pages.
Pekin, D. et al. "Quantitative and sensitive detection of rare mutations using droplet-based microfluidics", *Lab Chip*, 11(3): 2156-2166 (2011).
Pels et al. "Clonal evolution as pathogenetic mechanism in relapse of primary CNS lymphoma", *Neurology*, 63(1):167-169 (2004).
Perkel, J. "Overcoming the Challenges of Multiplex PCR", Biocompare Editorial Article, Oct. 23, 2012, 6 Pages, can be retrieved at URL:http://www.biocompare.com/Editorial-Articles/117895-Multiplex-PCR/>.
Pira et al. "Human naive CD4 T-cell clones specific for HIV envelope persist for years in vivo in the absence of antigenic challenge", *J Acquir Immune Defic Syndr.*, 40(2):132-139 (2005).
Plasilova et al. "Application of the Molecular Analysis of the T-Cell Receptor Repertoire in the Study of Immune-Mediated Hematologic Diseases", *Hematology*, 8(3): 173-181 (2003).
Pohl, G. and Shih. "Principle and applications of digital PCR", *Expert Rev. Mol. Diagn.*, 4(1):41-47 (2004).
Polstra, et al. "Development of real-time NASBA assays with molecular beacon detection to quantify mRNA coding for HHV-8 lytic and latent genes", *BMC Infect Dis.*, 2: 18 (2002). Epub Sep. 4, 2002.
Pop and Salzberg. "Bioinformatics challenges of new sequencing technology", *NIH, Trends Genet.*, 24(3): 142-149 (2008).
Pourmand, et al. "Direct electrical detection of DNA synthesis", *PNAS*, 103(17): 6466-6470 (2006). Epub Apr. 13, 2006.
Polz and Cavanaugh. "Bias in Template-to-Product Ratios in Multitemplate PCR", *Applied and Environmental Microbiology*, 64(10): 3724-3730 (1998).
Porter, et al. "Chimeric antigen receptor-modified T cells in chronic lymphoid leukemia", N Engl J Med., 365(8):725-33 (2011). doi: 10.1056/NEJMoa1103849. Epub Aug. 10, 2011.
Prabakaran et al. "454 antibody sequencing—error characterization and correction", *BMC Research Notes*, 4: 404 (2011).
Puisieux, I. et al., "Oligoclonality of Tumor-Infiltrating Lymphocytes from Human Melanomas," The Journal of Immunology, 153:2807-2818 (1994).
Putnam, et al. "Clinical grade manufacturing of human alloantigen-reactive regulatory T cells for use in transplantation", Am J Transplant., 13(11): 3010-20 (2013). doi: 10.1111/ajt.12433. EpubSep. 18, 2013.
Qiu et al. "DNA sequence-based "bar codes" for tracking the origins of expressed sequence tags from a maize cDNA library constructed using multiple mRNA sources", *Plant Physiology*, 133(2): 475-481 (2003).

(56) References Cited

OTHER PUBLICATIONS

Qu et al. "Efficient frequency-based de novo short-read clustering for error trimming in next-generation sequencing", *Genome Research*, 19: 1309-1315 (2009).
Quick. SOLiD System—a next-gen DNA sequencing platform announced, Gizmag online magazine, http://www.mizmag.com/go/8248, pp. 1-5, Oct. 2007.
Quince et al. "Removing Noise From Pyrosequenced Amplicons", *BMC Informatics*, 12: 38 (2011).
Ramesh, et al. "Clonal and constricted T cell repertoire in Common Variable Immune Deficiency", Clin Immunol., pii: S1521-6616(15)00004-2 (2015). doi: 10.1016/j.clim.2015.01.002. [Epub ahead of print].
Ramsden, et al. "V(D)J recombination: Born to be wild", *Semin Cancer Biol.*, 20(4): 254-260 (2010). doi: 10.1016/j.semcancer.2010.06.002. Epub Jul. 1, 2010.
Rasmussen, T. et al. "Quantitation of minimal residual disease in multiple myeloma using an allele-specific real-time PCR assay", *Experimental Hematology*, 28:1039-1045 (2000).
Ray, et al. "Single cell multiplex PCR amplification of five dystrophin gene exons combined with gender determination", *Molecular Human Reproduction*, 7(5): 489-494 (2001).
Reddy, et al. "Monoclonal antibodies isolated without screening by analyzing the variable-gene repertoire of plasma cells", *Nature Biotechnology*, 28(9): 965-969 (2010). doi: 10.1038/nbt.1673. Epub Aug. 29, 2010.
Reddy and Georgiou. "Systems analysis of adaptive immunity by utilization of high-throughput technologies", *Current Opinion in Biotechnology*, 22(4): 584-589 (2011).
Reinartz et al. "Massively parallel signature sequencing (MPSS) as a tool for in-depth quantitative gene expression profiling in all organisms", *Brief Funct Genomic Proteomic.*, 1(1):95-104 (2002).
Reischl and Kochanowski. "Quantitative PCR. A Survey of the Present Technology", *Molecular Biotechnology*, 3:55-71 (1995).
Ria, et al. "Collagen-specific T-cell repertoire in blood and synovial fluid varies with disease activity in early rheumatoid arthritis", *Arthritis Res Ther.*, 10(6):R135, 18 pp. (2008). Epub Nov. 17, 2008.
Rickinson and Moss. "Human cytotoxic T lymphocyte responses to Epstein-Barr virus infection", *Annu Rev Immunol.*, 15:405-431 (1997).
Rieder, et al. "A normalization procedure for removal of residual multiplex PCR amplification bias from ultra-deep sequencing of the TCR repertoire", (Program #530W). Presented at the 62nd Annual Meeting of the American Society of Human Genetics, Nov. 7, 2012 in San Francisco, California. 2 pages.
Rieder, et al. "A normalization procedure for removal of residual multiplex PCR amplification bias from ultra-deep sequencing of the TCR repertoire", Presented at the Annual Meeting of the American Society of Hematology 2012 in Atlanta, Georgia Dec. 8-11, 2012. Poster. 1 page.
Risitano et al. "In-vivo dominant immune responses in aplastic anaemia: molecular tracking of putatively pathogenetic T-cell clones by TCRβ-CDR3 sequencing", *Lancet*, 364:355-364 (2004).
Robert, et al. "CTLA4 blockade broadens the peripheral T-cell receptor repertoire", Clin Cancer Res., 20(9):2424-32 (2014). doi: 10.1158/1078-0432.CCR-13/2648. Epub Feb. 28, 2014.
Robins, H. et al. "Ultra-sensitive detection of rare T cell clones", *Journal of Immunological Methods*, 375(1- 2): 14-19 (2012). Epub Sep. 10, 2011.
Robins, et al. "CD4+ and CD8+ T cell β antigen receptors have different and predictable V and J gene usage and CDR3 lengths", *J. Immunol.*, 188: 115.10, Abstract (2012).
Robins et al. "Detecting and monitoring lymphoma with high-throughput sequencing" *Oncotarget*, 2:287-288 (2011).
Robins, H. et al. "Digital Genomic Quantification of Tumor Infiltrating Lymphocytes", *Science Translational Medicine*, 5:214ra169, 19 pages, Supplementary Materials (2013).
Robins, H. et al. "Comprehensive assessment of T-cell receptor β-chain diversity in αβ T cells", *Blood*, 114(19):4099-4107 (and Supplemental Materials) (2009).

Robins, et al. "Effects of aging on the human adaptive immune system revealed by high-throughput DNA sequencing of T cell receptors", *J Immunol.*, 188: 47.16, Abstract (2012).
Robins, et al. "High-throughput sequencing of T-cell receptors." Sep. 2010. Poster. 1 page.
Robins, et al. "Immune profiling with high-throughput sequencing." Presented for the ASHI 2011 conference. Oct. 2011. Poster. 1 page.
Robins, et al. "Immunosequencing: applications of immune repertoire deep sequencing", *Curr Opin Immunol.*, 25(5): 646-652 (2013). doi: 10.1016/j.coi.2013.09.017. Epub Oct. 16, 2013.
Robins, H. et al. "Overlap and Effective Size of the Human CD8+ T Cell Receptor Repertoire", *Science Transitional Medicine*, 2(47, 47ra64):17 pages, Supplemental Materials (2010).
Robins, et al. "Overlap of the human CD8+ T cell receptor repertoire." Oct. 2010. Poster. 1 page.
Robins. "Overlap and effective size of the human CD8+ T cell repertoire", Keystone Symposia held Oct. 27, 2010 to Nov. 1, 2010. Immunological Mechanisms of Vaccination (Abstract). Available online Sep. 27, 2010, 1 page.
Robins, H. et al. "The Computational Detection of Functional Nucleotide Sequence Motifs in the Coding Regions of Organisms", *Exp Biol Med*, 233(6): 665-673 (2008).
Rock, E.P. et al. "CDR3 Length in Antigen-specific Immune Receptors", *J. Exp. Med.*, 179:323-328 (1994).
Ronaghi, et al. "A sequencing method based on real-time pyrophosphate", *Science*, 281(5375): 363, 365, 5 pages (1998).
Rosenberg, S.A. et al. "New Approach to the Adoptive Immunotherapy of Cancer with Tumor-Infiltrating Lymphocytes", *Science*, 233(4770): 1318-1321 (1986).
Rosenquist, et al. "Clonal evolution as judged by immunoglobulin heavy chain gene rearrangements in relapsing precursor-B acute lymphoblastic leukemia", *Eur J Haematol.*, 63(3):171-179 (1999).
Roshal, M. et al. "Immaturity Associated Antigens Are Lost During Induction for T Cell Lymphoblastic Leukemia: Implications for Minimal Residual Disease Detection", *Cytometry Part B (Clinical Cytometry)*, 78:139-146 (2010).
Rothberg, et al. "An integrated semiconductor device enabling non-optical genome sequencing", *Nature*, 475(7356): 348-352 (2011). doi: 10.1038/nature10242.
Rothberg et al. "The development and impact of 454 sequencing", *Nature Biotechnology*, 26(10): 1117-1124 (2008).
Rougemont, et al. "Probabilistic base calling of Solexa sequencing data", *BMC Bioinformatics*, 9:431, 12 pages (2008).
Rozen, S. et al. "Primer3 on the WWW for General Users and for Biologist Programmers", *Methods in Molecular Biology, Bioinformatics Methods and Protocols*, 132:365-386 (2000).
Ryan et al. "Clonal evolution of lymphoblastoid cell lines", *Laboratory Investigation*, 86(11):1193-1200 (2006). Epub Oct. 2, 2006.
Saada, R. et al. "Models for antigen receptor gene rearrangement: CDR3 length", *Immunology and Cell Biology*, 85:323-332 (2007).
Salzberg. "Mind the gaps", *Nature Methods*, 7(2): 105-106 (2010).
Sanchez-Freire et al. "Microfluidic single-cell real-time PCR for comparative analysis of gene expression patterns", *Nature Protocols*, 7(5): 829-838 (2012).
Sandberg et al. "BIOMED-2 Multiplex Immunoglobulin/T-Cell Receptor Polymerase Chain Reaction Protocols Can Reliably Replace Southern Blot Analysis in Routine Clonality Diagnostics", *J. Molecular Diagnostics*, 7(4): 495-503 (2005).
Sandberg, et al. "Capturing whole-genome characteristics in short sequences using a naïve Bayesian classifier", *Genome Res.*, 11(8): 1404-9 (2001).
Santalucia, Jr., J. "Physical Principles and Visual-OMP Software for Optimal PCR Design," *Methods in Molecular Biology*, 402(PCR Primer Design):3-33, 40 pages (2007).
Santamaria, P. et al. "Beta-Cell-Cytotoxic CD8 T Cells from Nonobese Diabetic Mice Use Highly Homologous T Cell Receptor a-Chain CDR3 Sequences", *The Journal of Immunology*, 154(5):2494-2503 (1995).
Sartorius Stedim Biotech product brochure, "Primer removal after a PCR reaction with Vivacon® 2", (2010).

(56) References Cited

OTHER PUBLICATIONS

Sato et al. "Intraepithelial CD8+ tumor-infiltrating lymphocytes and a high CD8+/regulatory T cell ratio are associated with favorable prognosis in ovarian cancer", *PNAS*, 102(51): 18538-18543 (2005). Epub Dec. 12, 2005.

Satoh et al. "Pretreatment with restriction enzyme or bovine serum albumin for effective PCR amplification of Epstein-Barr virus DNA in DNA extracted from paraffin-embedded gastric carcinoma tissue", *J Clin Microbiol.*, 36(11): 3423-3425 (1998).

Schaufelberger et al. "An uneven expression of T cell receptor V genes in the arterial wall and peripheral blood in giant cell arteritis", *Inflammation*, 31(6):372-383 (2008).

Schlissel, M.S. et al. "Leukemia and lymphoma: a cost of doing business for adaptive immunity", *Genes Dev.*, 20(12): 1539-1544 (2006).

Schloss, PD et al. Reducing the Effects of PCR Amplification and Sequencing Artifacts on 16S Rrna-Based Studies. PLoS One. Dec. 14, 2011, vol. 6, No. 12; e27310; DOI: 1 0.1371/journal.pone. 002731 0.

Schmitt et al. "Detection of ultra-rare mutations by next-generation sequencing," *PNAS*, 109(36): 14508-14513 and Supporting Information, 9 pages (2012).

Schøller et al. "Analysis of T cell receptor αβ variability in lymphocytes infiltrating melanoma primary tumours and metastatic lesions", *Cancer Immunol Immunother.* 39(4):239-248 (1994).

Schrappe, M. et al. "Late MRD response determines relapse risk overall and in subsets of childhood T-cell ALL: results of the AIEOP-BFM-ALL 2000 study", *Blood*, 118(8): 2077-2084 (2011).

Schreiber et al. "Cancer immunoediting: integrating immunity's roles in cancer suppression and promotion", *Science*, 331(6024): 1565-1570 (2011). doi: 10.1126/science.1203486.

Schwab et al. "CD8+ T-cell clones dominate brain infiltrates in Rasmussen encephalitis and persist in the periphery", *Brain*, 132:1236-1246 (2009).

Schwartzman, Armin. "Empirical null and false discovery rate inference for exponential families." The Annals of Applied Statistics (2008); 2(4): 1332-1359.

Schweiger et al. "Genome-wide massively parallel sequencing of formaldehyde fixed-paraffin embedded (FFPE) tumor tissues for copy-number- and mutation-analysis", *PLoS One*, 4(5): e5548, 7 pages (2009). doi: 10.1371/journal.pone.0005548. Epub May 14, 2009.

Search Report in Chinese Patent Application No. 201510054401.X, dated Jul. 14, 2016, 2 pages.

Sebastian, E. et al., "Molecular Characterization of immunoglobulin gene rearrangements in diffuse large B-cell lymphoma", *Am. J. Pathol.*, 181: 1879-1888, Abstract (2012). (Epub: Sep. 28, 2012).

Sehouli et al. "Epigenetic quantification of tumor-infiltrating T-lymphocytes" *Epigenetics*, 6(2): 236-246 (2011). Epub Feb. 1, 2011.

Seitz, et al. "Reconstitution of paired T cell receptor α- and β-chains from microdissected single cells of human inflammatory tissues", *PNAS*, 103: 12057-12062 (2006).

Seo, et al. "Four-color DNA sequencing by synthesis on a chip using photocleavable fluorescent nucleotides", *PNAS*, 102(17): 5926-5931 (2005). Epub Apr. 13, 2005.

Sequenta and iRepertoire Join Forces on Blood Cancer Testing. Business Wire. Aug. 8, 2013. http://www.businesswire.com/news/home/20130808005363/en/SequentaiRepertoire-Join-Forces-Blo . . . #.VGTT9W dOyUk. 2 pages.

Sfanos et al. "Human Prostate-Infiltrating CD8+ T Lymphocytes are Oligoclonal and PD-1+", *The Prostate*, 69(15): 1694-1703 (2009).

Sfanos et al. "Phenotypic analysis of prostate-infiltrating lymphocytes reveals TH17 and Treg skewing", *Clinical Cancer Research*, 14(11):3254-3261 (2008). doi: 10.1158/1078-0432.CCR-07-5164.

Shen et al. "Comparing platforms for C. elegans mutant identification using high-throughput whole-genome sequencing", *PLoS One*, 3(12):e4012, 6 pages (2008).

Shendure, et al. "Accurate multiplex polony sequencing of an evolved bacterial genome", *Science*, 309(5741): 1728-1732, Abstract Only (2005). Epub Aug. 4, 2005.

Shendure, et al. "Advanced sequencing technologies: methods and goals", *Nat Rev Genet.*, 5(5): 335-344 (2004).

Shendure and Ji. "Next-generation DNA sequencing", *Nature Biotechnology*, 26(10):1135-1145 (2008).

Sherwood, A. et al. "Deep Sequencing of the Human TCRγ and TCRβ Repertoires Suggests that TCR β Rearranges After αβ and γδ T Cell Commitment, Science Translational Medicine", *Sci. Transl. Med.*, 3(90): 1-7 (2011).

Sherwood, et al. "New Technologies for Measurements of Tumor Infiltrating Lymphocytes", Presented Nov. 7, 2012 Moscone Center, Exhibit Halls ABC.

Sherwood, et al. "Tumor-infiltrating lymphocytes in colorectal tumors display a diversity of T cell receptor sequences that differ from the T cells in adjacent mucosal tissue", Cancer Immunol Immunother., 62(9):1453-61 (2013). doi: 10.1007/s00262-013-1446-2. Epub Jun. 16, 2013.

Shino, et al. "Usefulness of immune monitoring in lung transplantation using adenosine triphosphate production in activated lymphocytes", *The Journal of Heart and Lung Transplant*, 31: 996-1002 (2012).

Shiroguchi et al. "Digital RNA sequencing minimizes sequence-dependent bias and amplification noise with optimized single-molecule barcodes", *PNAS*, 109(4): 1347-1352 (2012).

Shoemaker et al. "Quantitative phenotypic analysis of yeast deletion mutants using a highly parallel molecular bar-coding strategy," *Nature Genetics*, 14(4): 450-456 (1996).

Shumaker, et al. "Mutation detection by solid phase primer extension", *Hum Mutat.*, 7(4): 346-354, Abstract Only (1996).

Sia, et al. "Microfluidic devices fabricated in poly(dimethylsiloxane) for biological studies", *Electrophoresis*, 24(21): 3563-3576, Abstract Only (2003).

Silver, N. et al. "Selection of housekeeping genes for gene expression studies in human reticulocytes using real-time PCR", *BMC Molecular Biology*, 7(33):1-9 (2006).

Sims, et al. "Fluorogenic DNA sequencing in PDMS microreactors", *Nat Methods*, 8(7): 575-580 (2011). doi: 10.1038/nmeth.1629.

Sims, et al. "MHC-peptide tetramers for the analysis of antigen-specific T cells", *Expert Rev Vaccines*, 9(7): 765-774 (2010). doi: 10.1586/erv.10.66.

Sing et al. "A molecular comparison of T Lymphocyte populations infiltrating the liver and circulating in the blood of patients with chronic hepatitis B: evidence for antigen-driven selection of a public complementarity-determining region 3 (CDR3) motif", *Hepatology*, 33(5):1288-1298 (2001).

Singapore Application No. 11201407888R, Written Opinion dated Aug. 14, 2015, 12 pages.

Singapore Application No. 11201500313Y, Search Report and Written Opinion dated Dec. 9, 2015, 11 pages.

Sint, D., et al. "Advances in multiplex PCR: balancing primer efficiencies and improving detection success", *Methods in Ecology and Evolution*, 3(5): 898-905 (2012).

Skulina et al. "Multiple Sclerosis: Brain-infiltrating CD8+ T cells persist as clonal expansions in the cerebrospinal fluid and blood", *PNAS*, 101(8):2428-2433 (2004).

Slightom, J.L. et al. "Homo sapiens germline beta T-cell receptor locus", NCBI Accession No. L36092 NCBI, 254 pages (2009) Retrieved from the Internet: <URL:http://www.ncbi.nlm.nih.gov/nuccore/L36092>.

Smith, et al. "Comparison of biosequences", *Advances in Applied Mathematics*, 2: 482-489 (1981).

Smith et al. "Rapid generation of fully human monoclonal antibodies specific to a vaccinating antigen", *Nature Protocols*, 4(3): 372-384 and CORRIGENDA (2009).

Smith et al. "Rapid whole-genome mutational profiling using next-generation sequencing technologies", *Genome Research*, 18: 1638-1642 (2008).

Smith et al. "Quantitative phenotyping via deep barcode sequencing", *Genome Research*, 19: 1836-1842 (2009).

Smith et al, "Using quality scores and longer reads improves accuracy of Solexa read mapping," BMC Bioinformatics, 9: 128 (2008).

(56) References Cited

OTHER PUBLICATIONS

Sobrino, et al. "SNPs in forensic genetics: a review on SNP typing methodologies", *Forensic Sci Int*, 154(2-3): 181-194, Abstract Only (2005). Epub Jan. 11, 2005.
Spreafico, et al. "A circulating reservoir of pathogenic-like CD4+ T cells shares a genetic and phenotypic signature with the inflamed synovial micro-environment", *Ann Rheum Dis*., 0: 1-7 (2014). doi: 10.1136/annrheumdis-2014-206226. [Epub ahead of print].
Sramkova, et al. "Detectable minimal residual disease before allogeneic hematopoietic stem cell transplantation predicts extremely poor prognosis in children with acute lymphoblastic leukemia", *Pediatr. Blood Cancer*, 48(1):93-100 (2007).
Srinivasan et al. "Effect of fixatives and tissue processing on the content and integrity of nucleic acids", *Am J Pathol*., 161(6): 1961-1971 (2002).
Srivastava and Robins. "Palindromic nucleotide analysis in human T cell receptor rearrangements", PLoS One, 7(12):e52250 (2012). doi: 10.1371/journal.pone.0052250. Epub Dec. 21, 2012.
Standard Sequencing Primers, Max Planck Genome Center Cologne, Jan. 15, 2011, 2 pages, downloaded from https://genomecentre. mpipz.mpg.de/SeqOrderDB/export/sequencing-primers.html.
Stanley. Essentials of Immunology & Serology, Delmar, Thomson Learning, Chapter 7, T cells, p. 95 (2002).
Steenbergen, et al. "Distinct ongoing Ig heavy chain rearrangement processes in childhood B-precursor acute lymphoblastic leukemia", *Blood*, 82(2):581-589 (1993).
Steenbergen, et al. "Frequent ongoing T-cell receptor rearrangements in childhood B-precursor acute lymphoblastic leukemia: implications for monitoring minimal residual disease", *Blood*, 86(2): 692-702, Abstract Only (1995).
Stein and Nombela-Arrieta. "Chemokine control of lymphocyte trafficking: a general overview", *Immunology*, 116(10):1-12 (2005).
Steinmetz, O.M. et al. "Chemokines and B cells in renal inflammation and allograft rejection", *Frontiers in Bioscience (Schol. Ed.)*, 1:13-22 (2009).
Stemmer, et al. "Single-step assembly of a gene and entire plasmid from large numbers of oligodeoxyribonucleotides", *Gene*, 164(1): 49-53 (1995).
Steward et al. "A polymerase chain reaction study of the stability of Ig heavy-chain and T-cell receptor delta gene rearrangements between presentation and relapse of childhood B-lineage acute lymphoblastic leukemia", *Blood*, 83(5):1355-1362 (1994).
Stewart and Schwartz. "Immunoglobulin V regions and the B cell", *Blood*, 83(7): 1717-1730 (1994).
Stickler, et al. "An in vitro human cell-based assay to rank the relative immunogenicity of proteins", *Toxicol Sci*., 77(2): 280-289 (2004). Epub Dec. 22, 2003.
Stiller et al. "Direct multiplex sequencing (DMPS)—a novel method for targeted high-throughput sequencing of ancient and highly degraded DNA", *Genome Research*, 19: 1843-849 (2009).
Straten, Per thor, et al. "T-cell clonotypes in cancer", *Journal of Translational Medicine*, 2(1): 11, 10 pages (2004).
Stratton. "Exploring the genomes of cancer cells: progress and promise", *Science*, 331(6024): 1553-1558 (2011). doi: 10.1126/science.1204040.
Striebich, et al. "Selective Accumulation of Related CD41 T Cell Clones in the Synovial Fluid of Patients with Rheumatoid Arthritis", *J Immunol*., 161(8): 4428-36 (1998).
Struyk et al. "T cell receptors in rheumatoid arthritis", *Arthritis & Rheumatism*, 38(5):577-589 (1995).
Sumida et al. "T cell receptor repertoire of infiltrating T cells in lips of Sjögren's syndrome patients", *J Clin Invest*., 89:681-685 (1992).
Sumida et al. "T cell receptor VA repertoire of infiltrating T cells in labial salivary glands from patients with Sjögren's syndrome", *J Rheumatol*., 21:1655-1661 (1994).
Swarup and Rajeswari. "Circulating (cell-free) nucleic acids—a promising, non-invasive tool for early detection of several human diseases", *FEBS Letters*, 581(5): 795-799 (2007). Epub Feb. 2, 2007.
Szczepanski et al. "Comparative analysis of Ig and TCR gene rearrangements at diagnosis and at relapse of childhood precursor-B-ALL provides improved strategies for selection of stable PCR targets for monitoring of minimal residual disease", *Blood*, 99(7):2315-2323 (2002).
Szczepanski, T. et al. "Minimal residual disease in leukemia patients", *Lancet Oncology*, 2:409-417 (2001).
Szczepanski et al. "Why and how to quantify minimal residual disease in acute lymphoblastic leukemia?", *Leukemia*, 21(4):622-626 (2007). Epub Feb. 15, 2007.
Tackenberg et al. "Clonal expansions of CD4+ β helper T cells in autoimmune myasthenia gravis", *European Journal of Immunology*, 37(3):849-863 (2007).
Tajiri et al. "Cell-microarray analysis of antigen-specific B-cells: single cell analysis of antigen receptor expression and specificity", *Cytometry Part A*, 71A: 961-967 (2007).
Takamatsu, et al., "A comparison between next-generation sequencing and ASO-qPCR for minimal residual disease detection in multiple myeloma", *J. Clin. Oncol*., 31(Supplement 1): Abstract 8601 (Conference Abstract), Entire Abstract (2013).
Tanaka et al. "Single-Cell Analysis of T-Cell Receptor Repertoire of HTLV-1 Tax-Specific Cytotoxic T Cells in Allogeneic Transplant Recipients with Adult T-Cell Leukemia/Lymphoma", *Cancer Research*, 70: 6181-6192 (2010).
Taubenheim et al. "High Rate of Antibody Secretion Is not Integral to Plasma Cell Differentiation as Revealed by XBP-1 Deficiency", *The Journal of Immunology*, 189: 3328-3338 (2012).
Tautz, et al. "Cryptic simplicity in DNA is a major source of genetic variation", *Nature*, 322(6080): 652-656 (1986).
Tawfik, et al. "Man-made cell-like compartments for molecular evolution", *Nat Biotechnol*., 16(7): 652-656, Abstract Only (1998).
Ten Bosch et al. "Keeping Up With the Next Generation Massively Parallel Sequencing in Clinical Diagnostics", *Journal of Molecular Diagnostics*, 10(6): 484-492 (2008).
Tewhey, R. et al. "Corrigendum: Microdroplet-based PCR enrichment for large-scale targeted sequencing", *Nature Biotechnology*, 28(2):178, 1 page (2010).
Tewhey, R. et al. "Microdroplet-based PCR enrichment for large-scale targeted sequencing," *Nature Biotechnology*, 27(11):1025-1031 (2009).
Thiel, et al. "Antigen-specific cytometry—new tools arrived!", *Clin Immunol*., 111(2): 155-161, Abstract Only (2004).
Thornhill et al. "A comparison of different lysis buffers to assess allele dropout from single cells for preimplantation genetic diagnosis", *Prenatal Diagnosis*, 21:490-497 (2001).
Tokimitsu et al. "Single lymphocyte analysis with a microwell array chip", *Cytometry Part A*, 71A:1003-1010 (2007).
Toriello et al. "Integrated microfluidic bioprocessor for single-cell gene expression analysis", *PNAS*, 105(51): 20173-20178 (2008).
Triebel, F. et al. "A Unique V-J-C-Rearranged Gene Encodes A γ Protein Expressed on the Majority of CD3+ T Cell Receptor -a/fr Circulating Lymphocytes", *J. Exp. Med*., 167:694-699 (1988).
Tsai et al. "Discovery of rare mutations in populations: TILLING by sequencing", Plant Physiology, 156(3): 1257-1268 (and Supplemental Data) (2011).
Tsankova, et al. "Peripheral T-cell lymphoma emerging in a patient with aggressive polymyositis: molecular evidence for neoplastic transformation of an oligo clonal T-cell infiltrate", Acta Neuropathol., 126(4):595-601 (2013). doi: 10.1007/s00401-013-1164-z. Epub Aug. 13, 2013.
Tschumper, et al. "Comprehensive assessment of potential multiple myeloma immunoglobulin heavy chain V-D-J intraclonal variation using massively parallel pyrosequencing", *Oncotarget*, 3(4): 502-513 (2012).
Turcotte and Rosenberg. "Immunotherapy for metastatic solid cancers", *Adv Surg*., 45: 341-360 (2011).
UK combined search and examination report dated Mar. 20, 2013 for GB 1300533.5.
UK Combined Search Report and Office action dated Jun. 29, 2012 for UK application No. GB1209668.1.
UK Combined Search Report and Office action dated May 27, 2011 for UK application No. GB1105068.9.

(56) References Cited

OTHER PUBLICATIONS

UK Search Report and office action dated Jan. 13, 2012 for UK application No. GB1120209.0.
UK Search Report and office action dated Jul. 7, 2010 for UK application No. GB1009641.0.
Umibe et al. "Clonal expansion of T cells infiltrating in the airways of non-atopic asthmatics", *Clinical & Experimental Immunology*, 119(3):390-397 (2000).
Unrau and Deugau. "Non-cloning amplification of specific DNA fragments from whole genomic DNA digests using DNA 'indexers'", *Gene.*, 145(2): 163-169, Abstract Only, 2 pages (1994).
Uppaluri et al. "Focus on TILs: prognostic significance of tumor infiltrating lymphocytes in head and neck cancers", *Cancer Immunity*, 8:16, 10 pages (2008).
Urban, et al. "A systematic and quantitative analysis of PCR template contamination", *J Forensic Sci.*, 45(6): 1307-1311 (2000).
Urquhart, et al. "Rate-controlled delivery systems in drug and hormone research", *Annu Rev Pharmacol Toxicol.*, 24: 199-236, Abstract Only (1984).
Van Der Velden, V.H.J., et al. "Analysis of minimal residual disease by Ig/TCR gene rearrangements: guidelines for interpretation of real-time quantitative PCR data," *Leukemia*, 21:604-611 (2007).
Van Der Velden, V.H.J., et al. "Detection of minimal residual disease in hematologic malignancies by realtime quantitative PCR: principles, approaches, and laboratory aspects," *Leukemia*, 17:1013-1034 (2003).
Van Der Velden, V.H.J., et al. "Optimization of PCR-based minimal residual disease diagnostics for childhood acute lymphoblastic leukemia in a multi-center setting," *Leukemia*, 21:706-713 (2007).
Van Der Velden, V.H.J., et al. "Real-time quantitative PCR for detection of minimal residual disease before allogeneic stem cell transplantation predicts outcome in children with acute lymphoblastic leukemia", *Leukemia*, 15:1485-1487 (2001).
Van Dongen, J.J.M. et al. "Design and standardization of PCR primers and protocols for detection of clonal immunoglobulin and l-cell receptor gene recombinations in suspect lymphoproliferations: Report of the BIOMED-2 Concerted Action BMHC-CT98-3936", *Leukemia*, 17:2257-2317 (2003).
Van Dongen, J.J.M. et al. "Prognostic value of minimal residual disease in acute lymphoblastic leukaemia in childhood", *The Lancet*, 352:1731-1738 (1998).
Vanderborght, et al. "Dynamic T cell receptor clonotype changes in synovial tissue of patients with early rheumatoid arthritis: effects of treatment with cyclosporin A (Neoral)", *J Rheumatol.*, 29(3): 416-426 (2002).
Varley and Mitra. "Nested patch PCR enables highly multiplexed mutation discovery in candidate genes", *Genome Research*, 18: 1844-1850 (2008).
Venturi, et al. "A mechanism for TCR sharing between T cell subsets and individuals revealed by pyrosequencing", *J Immunol .*, 186(7): 4285-4294 (2011). doi: 10.4049/jimmunol.1003898. Epub Mar. 7, 2011.
Venturi, V. et al. "TCR β-Chain Sharing in Human CD8+ T Cell Responses to Cytomegalovirus and EBV[1]", *The Journal of Immunology*, 181:7853-7862 (2008).
Venturi, V. et al. "The molecular basis for public T-cell responses?", *Nature Reviews*, 8:231-238 (2008).
Verhagen, O.J.H.M., et al. "Application of germline Igh probes in real-time quantitative PCR for the detection of minimal residual disease in acute lymphoblastic leukemia", *Leukemia*, 14:1426-1435 (2000).
Vester, et al. "LNA (locked nucleic acid): high-affinity targeting of complementary RNA and DNA", *Biochemistry*, 43(42): 13233-13241, Abstract Only (2004).
Vlassov, et al. "Circulating nucleic acids as a potential source for cancer biomarkers", *Curr Mol Med.*, 10(2): 142-165 (2010).
Vogelstein et al. "Cancer genome landscapes", *Science*, 339(6127): 1546-1558 (2013). doi: 10.1126/science.1235122.
Vogelstein and Kinzler. "Digital PCR," *Genetics, PNAS*, 96:9236-9241 (1999).
Wälchli, et al. "A practical approach to T-cell receptor cloning and expression", *PLoS One*, 6(11): e27930, 11 pp. (2011). doi: 10.1371/journal.pone.0027930. Epub Nov. 21, 2011.
Wang, et al. "Balanced-PCR amplification allows unbiased identification of genomic copy changes in minute cell and tissue samples", *Nucleic Acids Research*, 32(9): e76, 10 pages (2004).
Wang, et al. "High throughput sequencing reveals a complex pattern of dynamic interrelationships among human T cell subsets", *PNAS*, 107(4): 1518-1528 (2010).
Wang, et al. "HIV integration site selection: Analysis by massively parallel pyrosequencing reveals association with epigenetic modifications", *Genome Research*, 17(8): 1186-1194 (2007). EpubJun. 1, 2007.
Wang et al. "Immunorepertoire analysis by multiplex PCR amplification and high throughput sequencing", Poster-Program 42.6, the 96th Annual Meeting of the America Association of Immunologists, Seattle, USA, May 8-12, 2009, 1 page.
Wang, X. et al. "Quantitative Measurement of Pathogen Specific Human Memory T Cell Repertoire Diversity using a CDR3 B-Specific Microarray", *BMC Genomics*, 8(329): 1-13 (2007).
Ward and Marelli-Berg. "Mechanisms of chemokine and antigen-dependent T-lymphocyte navigation", *Biochem. J.*, 418:13-27 (2009).
Warren et al. "Exhaustive T-cell repertoire sequencing of human peripheral blood samples reveals signatures of antigen selection and a directly measured repertoire size of at least 1 million clonotypes", *Genome Res.*, 21(5): 790-797 (2011). Epub Feb. 24, 2011.
Warren et al. "Profiling model T-cell metagenomes with short reads", *Bioinformatics*, 25(4):458-464 (2009).
Weinstein, J.A. et al. "High-Throughput Sequencing of the Zebrafish Antibody Repertoire", *Science*, 324(5928): 807-810 (2009).
Weinstein, J.A. et al. "High-Throughput Sequencing of the Zebrafish Antibody Repertoire", *Science*, 324(5928): 807-810, Supporting/Supplementary Materials (2009).
Weiss et al. "Clonal Rearrangements of T-Cell Receptor Genes in Mycosis Fungoides and Dermatopathic Lymphadenopathy", *The New England Journal of Medicine*, 313(9):539-544 (1985).
Welch and Link. "Genomics of AML: clinical applications of next-generation sequencing", *American Society of Hematology*, 2011: 30-35 (2011). doi: 10.1182/asheducation-2011.1.30.
Wells, et al. "Rapid evolution of peptide and protein binding properties in vitro", *Curr Opin Biotechnol.*, 3(4): 355-362, Abstract Only (1992).
Wells, et al. "Strategies for preimplantation genetic diagnosis of single gene disorders by DNA amplification", *Prenatal Diagnosis*, 18(13):1389-1401 (1998).
Weng, et al. "Minimal residual disease monitoring with high-throughput sequencing of T cell receptors in cutaneous T cell lymphoma", Sci Transl Med., 5(214):214ra171 (2013). doi: 10.1126/scitranslmed.3007420.
Westermann and Pabst. "Distribution of lymphocyte subsets and natural killer cells in the human body", *Clin Investig.*, 70(7): 539-544 (1992).
Wetmur and Chen. "An emulsion polymerase chain reaction-based method for molecular haplotyping", *Methods in Molecular Biology*, 410: 351-361 (1996).
Wetmur and Chen. "Linking emulsion PCR haplotype analysis", chapter 11, Park, D.J. (ed.), *PCR Protocols, Methods in Molecular Biology*, 687: 165-175 (2011).
Wetmur et al. "Molecular haplotyping by linking emulsion PCR: analysis of paraoxonase 1 haplotypes and phenotypes", *Nucleic Acids Research*, 33(8):2615-2619 (2005).
Weusten, et al. "Principles of quantitation of viral loads using nucleic acid sequence-based amplification in combination with homogeneo detection using molecular beacons", Nucleic Acids Res., 30(6): e26, 7 pages (2002).
White et al. "High-throughput microfluidic single-cell RT-qPCR", *PNAS*, 108(34): 13999-14004 (2011).
Whiteford, et al. "Swift: primary data analysis for the Illumina Solexa sequencing platform", *Bioinformatics*, 25(17): 2194-2199 (2009). doi: 10.1093/bioinformatics/btp383. Epub Jun. 23, 2009.
Williams, et al. "Amplification of complex gene libraries by emulsion PCR", *Nat Methods*, 3(7): 545-550 (2006).

(56) References Cited

OTHER PUBLICATIONS

Wlodarski et al. "Molecular strategies for detection and quantitation of clonal cytotoxic T-cell responses in aplastic anemia and myelodysplastic syndrome", *Blood*, 108(8):2632-2641 (2006).

Wlodarski et al. "Pathologic clonal cytotoxic T-cell responses: nonrandom nature of the T-cell-receptor restriction in large granular lymphocyte leukemia", *Blood*, 106:2769-2779 (2005).

Wolda. "Similarity Indices, Sample Size and Diversity", *Oecologia* (Berl), 50:296-302 (1981).

Wolfl, et al. "Activation-induced expression of CD137 permits detection, isolation, and expansion of the full repertoire of CD8+ T cells responding to antigen without requiring knowledge of epitope specificities", *Blood*, 110(1): 201-210 (2007). Epub Mar. 19, 2007.

Wolfl, et al. "Use of CD137 to study the full repertoire of CD8+ T cells without the need to know epitope specificities", *Cytometry A.*, 73(11): 1043-1049 (2008). doi: 10.1002/cyto.a.20594.

Wood, B. "9-Color and 10-Color Flow Cytometry in the Clinical Laboratory", *Arch Pathol Lab Med*, 130:680-690 (2006).

Wood, et al. "Using next-generation sequencing for high resolution multiplex analysis of copy number variation from nanogram quantities of DNA from formalin-fixed paraffin-embedded specimens", *Nucleic Acids Research*, 38(14): e151, 11 pages (2010). doi: 10.1093/nar/gkq510. Epub Jun. 4, 2010.

Woodsworth, Daniel J., et al., "Sequence analysis of T-cell repertoires in health and disease." Genome Medicine (2013); 5: 98, 13 pages.

Wrammert et al. "Rapid cloning of high-affinity human monoclonal antibodies against influenza virus", *Nature*, 453: 667-672 (2008).

Wu, et al. "High-throughput sequencing detects minimal residual disease in acute T lymphoblastic leukemia", Sci Transl Med., 4(134):134ra63 (2012). doi: 10.1126/scitranslmed.3003656.

Wu, et al. "High-throughput sequencing of T-cell receptor gene loci for minimal residual disease monitoring in T Lymphoblastic Leukemia", Blood, 118: 2545 (Abstr) (2011).

Wu, Y-C. et al. "High-throughput immunoglobulin repertoire analysis distinguishes between human IgM memory and switched memory B-cell populations", *Blood Journal*, 116(7): 1070-1078, 22 pages (2010).

Wu et al. "Focused Evolution of HIV-1 Neutralizing Antibodies Revealed by Structures and Deep Sequencing", *Science*, 333: 1593-1602 (2011).

Wu, H.D. et al. "The Lymphocytic Infiltration in Calcific Aortic Stenosis Predominantly Consists of Clonally Expanded T Cells", *The Journal of Immunology*, 178(8): 5329-5339 (2007).

Xie, Yang, et al., "A note on using permutation-based false discovery rate estimates to compare different analysis methods for microarray data." Bioinformatics (2005); 21.23: 4280-4288.

Xiong, et al. "Chemical gene synthesis: strategies, softwares, error corrections, and applications", *FEMS Microbiol Rev.*, 32(3): 522-540 (2008). doi: 10.1111/j.1574-6976.2008.00109.x. Epub Apr. 2, 2008.

Xiong, et al. "Non-polymerase-cycling-assembly-based chemical gene synthesis: strategies, methods, and progress", *Biotechnol Adv.*, 26(2): 121-134, Abstract Only (2008). Epub Nov. 7, 2007.

Xu, W. et al. "A Novel Universal Primer-Multiplex-PCR Method with Sequencing Gel Electrophoresis Analysis", *PLoS One*, 7(1): e22900, 10 pages (2012).

Xu, et al. "Simultaneous isolation of DNA and RNA from the same cell population obtained by laser capture microdissection for genome and transcriptome profiling", *J Mol Diagn.*, 10(2):129-134 (2008). doi: 10.2353/jmoldx.2008.070131. Epub Feb. 7, 2008.

Yao, et al. "Analysis of the CDR3 length repertoire and the diversity of TCRα chain in human peripheral blood T Lymphocytes", Cell Mol Immunol., 4(3): 215-220 (2007).

Yeh, et al. "Regulating DNA translocation through functionalized soft nanopores", *Nanoscale*, 4(8): 26854693, Abstract Only (2012). doi: 10.1039/c2nr30102d. Epub Mar. 15, 2012.

Yassai, M.B. et al. "A clonotype nomenclature for T cell receptors", *Immunogenetics*, 61:493-502 (2009).

Yin et al. "Antiretroviral therapy restores diversity in the T-cell receptor Vβ repertoire of CD4 T-cell subpopulations among human immunodeficiency virus type 1-infected children and adolescents", *Clinical and Vaccine Immunology*, 16(9):1293-1301 (2009).

Yon and Fried. "Precise gene fusion by PCR", *Nucleic Acids Research*, 17(12):4895, 1 page (1989).

York, et al. "Highly parallel oligonucleotide purification and functionalization using reversible chemistry", *Nucleic Acids Res.*, 40(1): e4, 7 pages (2012). doi: 10.1093/nar/gkr910. Epub Oct. 29, 2011.

Yu and Fu. "Tumor-infiltrating T lymphocytes: friends or foes?", *Lab Invest.*, 86(3): 231-245 (2006).

Zagnoni, et al. "Droplet Microfluidics for High-throughput Analysis of Cells and Particles", *Methods in Cell Biology*, Chapter 2, 102: 23-48 (2011).

Zaliova, et al. "Quantification of fusion transcript reveals a subgroup with distinct biological properties and predicts relapse in BCR/ABL-positive ALL: implications for residual disease monitoring", *Leukemia*,23(5):944-951 (2009).

Zehentner et al. "Minimal Disease Detection and Confirmation in Hematologic Malignancies: Combining Cell Sorting with Clonality Profiling", *Clinical Chemistry*, 52(3): 430-437 (2006).

Zeng et al. "High-performance single cell genetic analysis using microfluidic emulsion generator arrays", *Anal. Chem.*, 82(8):3183-3190 (2010).

Zhong, Q. et al. "Multiplex digital PCR: breaking the one target per color barrier of quantitative PCR", Lab Chip, 11:2167-2174 (2011).

Zhou et al. "High throughput analysis of TCR-β rearrangement and gene expression in single cells", *Laboratory Investigation*, 86: 314-321 (2006).

Zhou et al. "Isolation of purified and live Foxp3+ regulatory T cells using FACS sorting on scatter plot", *J Mol Cell Biol.*, 2(3): 164-169 (2010). doi: 10.1093/jmcb/mjq007. Epub Apr. 29, 2010.

Zhu, et al. "Immune surveillance by CD8αα+ skin-resident T cells in human herpes virus infection", Nature, 497(7450):494-7 and Corrigendum (2013). doi: 10.1038/nature12110. Epub May 8, 2013.

Zimmerman and Mannhalter. "Technical aspects of quantitative competitive PCR", *Biotechniques*, 21: 268-279 (1996).

Cha et al., "Improved Survival with T Cell Clonotype Stability After Anti-CTLA-4 Treatment in Cancer Patients." Sci Transl Med (2014); 6(238): 238ra70.

European Patent Application No. 16183402.3, Extended European Search Report dated Feb. 21, 2017, 8 pages.

European Patent Application No. 15772627.4, Extended European Search Report dated Jul. 19, 2017, 8 pages.

Japanese Patent Application No. 2014800254909, Search Report and English translation, dated May 25, 2017, mailed by the Japanese Patent Office dated Jun. 6, 2017, 5 pages.

PCT/US2015/018967, International Preliminary Report on Patentability dated Oct. 18, 2016, 11 pages.

Van Heijst, J.W.J., et al., "Quantitative assessment of T-cell repertoire recovery after hematopoietic stem cell transplantation." Nat Med. (2013); 19(3): 372-377.

Wilson-Lingardo et al., "Deconvolution of Combinatorial Libraries for Drug Discovery: Experimental Comparison of Pooling Strategies." J. Med. Chem., (1996); 39 (14): 2720-2726.

Bonilla, F.A. et al., "Adaptive Immunity." J. Allergy Clin. Immunol. (2010); 125: S33-S40.

Dziubianau, M., et al., "TCR repertoire analysis by next generation sequencing allows complex differential diagnosis of T cell-related pathology." Am J Transplant (2013); 13(11): 2842-2854. doi: 10.1111/ajt.12431. Epub Sep. 10, 2013.

European Patent Application No. 15779750.7, Extended European Search Report dated Aug. 9, 2017, 9 pages.

European Patent Application No. 15758762.7, Extended European Search Report dated Sep. 22, 2017, 12 pages.

European Patent Application No. 15854358.7, Extended European Search Report dated Mar. 12, 2018, 12 pages.

European Patent Application No. 18153536.0, Extended European Search Report dated Jun. 6, 2018, 7 pages.

(56) References Cited

OTHER PUBLICATIONS

European Patent Application No. 16756268.5, Partial Supplementary European Search Report dated Jun. 19, 2018, 21 pages.

Födinger et al., "Multiplex PCR for rapid detection of T-cell receptor-gamma chain gene rearrangements in patients with lymphoproliferative diseases." British Journal of Haematology (1996); 94(1): 136-139.

Howie, et al., "High throughput pairing of T cell receptor α and β sequences." Science Translational Medicine (2015); 7(301): 301ra131, and supplementary materials, 19 pages.

Panzara, et al., "Analysis of the T cell repertoire using the PCR and specific oligonucleotide primers." Biotechniques (1992); 12(5): 728-735.

PCT/US2016/019343, International Preliminary Report on Patentability dated Aug. 29, 2017, 14 pages.

PCT/US2016/025535, International Preliminary Report on Patentability dated Oct. 3, 2017, 7 pages.

Sotomayor, et al., "Conversion of tumor-specific CD4+ T-cell tolerance to T-cell priming through in vivo ligation of CD40." Nature Medicine (1999); 5(7): 780-787.

Szczepek, et al., "A high frequency of circulating B cells share clonotypic Ig heavy-chain VDJ rearrangements with autologous bone marrow plasma cells in multiple myeloma, as measured by single-cell and in situ reverse transcriptase-polymerase chain reaction." Blood (1998); 92(8): 2844-2855.

Willenbrock, et al., "Analysis of T-Cell Subpopulations in T-Cell Non-Hodgkin's Lymphoma of Angioimmunoblastic Lymphadenopathy with Dysproteinemia Type by Single Target Gene Amplification of T Cell Receptor-β Gene Rearrangements." Am J Pathol. (2001); 158(5): 1851-1857.

Yagi, et al., "Detection of clonotypic IGH and TCR rearrangements in the neonatal blood spots of infants and children with B-cell precursor acute lymphoblastic leukemia." Blood (2000); 96(1): 264-268.

Han, et al., "Linking T-cell receptor sequence to functional phenotype at the single-cell level." Nat Biotechnol. (2014); 32 (7): 684-692. Epub Jun. 22, 2014.

QUANTIFICATION OF ADAPTIVE IMMUNE CELL GENOMES IN A COMPLEX MIXTURE OF CELLS

CROSS REFERENCE TO RELATED APPLICATIONS

This application claim priority to U.S. App. No. 61/981,085 filed Apr. 17, 2014 and U.S. App. No. 61/983,920, filed Apr. 24, 2014 and is related to U.S. application Ser. No. 13/656,265, filed on Oct. 21, 2012, International App. No. PCT/US2012/061193, filed on Oct. 21, 2012, and International Application No. PCT/US2013/040221, filed May 8, 2013, each of which is hereby incorporated by reference in its entirety.

SEQUENCE LISTING

The Sequence Listing associated with this application is provided in text format in lieu of a paper copy, and is hereby incorporated by reference into the specification. The name of the text file containing the Sequence Listing is 26341 US_CRF_sequencelisting.txt. This text file was created on Mar. 5, 2015, 2014, is about 2.08 MB in size, and is being submitted electronically via EFS-Web.

BACKGROUND

The adaptive immune system protects higher organisms against infections and other pathological events that may be attributable to foreign substances, using adaptive immune receptors, the antigen-specific recognition proteins that are expressed by hematopoietic cells of the lymphoid lineage and that are capable of distinguishing self from non-self molecules in the host. These lymphocytes may be found in the circulation and tissues of a host, and their recirculation between blood and the lymphatics has been described, including their extravasation via lymph node high endothelial venules, as well as at sites of infection, inflammation, tissue injury and other clinical insults. (See, e.g., Stein et al., 2005 *Immunol.* 116:1-12; DeNucci et al., 2009 *Crit. Rev. Immunol.* 29:87-109; Marelli-Berg et al., 2010 *Immunol.* 130:158; Ward et al., 2009 *Biochem. J.* 418:13; Gonzalez et al., 2011 *Ann. Rev. Immunol.* 29:215; Kehrl et al., 2009 *Curr. Top. Microb. Immunol.* 334:107; Steinmetz et al., 2009 *Front. Biosci.* (*Schol. Ed.*) 1:13.)

Accordingly, the dynamic nature of movement by lymphocytes throughout a host organism is reflected in changes in the qualitative (e.g., antigen-specificity of the clonally expressed adaptive immune receptor (immunoglobulin or T cell receptor), T cell versus B cell, T helper ($T_h$) cell versus T regulatory ($T_{reg}$) cell, effector T cell versus memory T cell, etc.) and quantitative distribution of lymphocytes among tissues, as a function of changes in host immune status.

For example, numerous studies have found an association between (i) the presence of tumor infiltrating lymphocytes (TIL) in a variety of solid tumors and (ii) patient prognosis and overall survival rates. In some studies, tumor infiltrating T cells having a specific phenotype (e.g., CD8+ and CD4+ T cells or regulatory T cells) are positive or negative predictors of survival (e.g., Jochems et al., 2011 *Experimental Biol. Med.* 236:567-579). In certain cases, however, TIL count alone is a predictor of long-term survival (e.g., Katz et al., 2009 *Ann. Surg. Oncol.* 16:2524-2530). Thus, quantitative determination of TIL counts has high prognostic value in a variety of cancers including colorectal, hepatocellular, gallbladder, pancreatic, esophageal, ovarian endometrial, cervical, bladder and urothelial cancers. While more is known about the association of tumor-infiltrating T cells, B cells are also known to infiltrate tumors and studies have shown an association of tumor-infiltrating B cells with survival advantage (e.g., Ladányi, et al., *Cancer Immunol. Immunother.* 60(12):1729-38, Jul. 21, 2011 (epub ahead of print).

The quantitative determination of the presence of adaptive immune cells (e.g., T and B lymphocytes) in diseased tissues may therefore provide useful information for diagnostic, prognostic and other purposes, such as in cancer, infection, inflammation, tissue injury and other conditions.

The adaptive immune system employs several strategies to generate a repertoire of T- and B-cell antigen receptors with sufficient diversity to recognize the universe of potential pathogens. B lymphocytes mature to express antibodies (immunoglobulins, Igs) that occur as heterodimers of a heavy (H) a light (L) chain polypeptide, while T lymphocytes express heterodimeric T cell receptors (TCR). The ability of T cells to recognize the universe of antigens associated with various cancers or infectious organisms is conferred by its T cell antigen receptor (TCR), which is made up of both an α (alpha) chain and a β (beta) chain or a γ (gamma) and a δ (delta) chain. The proteins which make up these chains are encoded by DNA, which employs a unique mechanism for generating the tremendous diversity of the TCR. This multi-subunit immune recognition receptor associates with the CD3 complex and binds to peptides presented by the major histocompatibility complex (MHC) class I and II proteins on the surface of antigen-presenting cells (APCs). Binding of TCR to the antigenic peptide on the APC is the central event in T cell activation, which occurs at an immunological synapse at the point of contact between the T cell and the APC.

Each TCR peptide contains variable complementarity determining regions (CDRs), as well as framework regions (FRs) and a constant region. The sequence diversity of αβ T cells is largely determined by the amino acid sequence of the third complementarity-determining region (CDR3) loops of the α and β chain variable domains, which diversity is a result of recombination between variable ($V_\beta$), diversity ($D_\beta$), and joining ($J_\beta$) gene segments in the β chain locus, and between analogous $V_\alpha$ and $J_\alpha$ gene segments in the α chain locus, respectively. The existence of multiple such gene segments in the TCR α and β chain loci allows for a large number of distinct CDR3 sequences to be encoded. CDR3 sequence diversity is further increased by independent addition and deletion of nucleotides at the $V_\beta$-$D_\beta$, $D_\beta$-$J_\beta$, and $V_\alpha$-$J_\alpha$ junctions during the process of TCR gene rearrangement. In this respect, immunocompetence is reflected in the diversity of TCRs.

The γδ TCR is distinctive from the αβ TCR in that it encodes a receptor that interacts closely with the innate immune system. TCRγδ, is expressed early in development, has specialized anatomical distribution, has unique pathogen and small-molecule specificities, and has a broad spectrum of innate and adaptive cellular interactions. A biased pattern of TCRγ V and J segment expression is established early in ontogeny as the restricted subsets of TCRγδ cells populate the mouth, skin, gut, vagina, and lungs prenatally. Consequently, the diverse TCRγ repertoire in adult tissues is the result of extensive peripheral expansion following stimulation by environmental exposure to pathogens and toxic molecules.

Igs expressed by B cells are proteins consisting of four polypeptide chains, two heavy chains (H chains) and two light chains (L chains), forming an $H_2L_2$ structure. Each pair of H and L chains contains a hypervariable domain, consisting of a $V_L$ and a $V_H$ region, and a constant domain. The H chains of Igs are of several types, μ, δ, γ, α, and β. The diversity of Igs within an individual is mainly determined by the hypervariable domain. Similar to the TCR, the V domain of H chains is created by the combinatorial joining of the $V_H$, $D_H$, and $J_H$ gene segments. Hypervariable domain sequence diversity is further increased by independent addition and deletion of nucleotides at the $V_H$-$D_H$, $D_H$-$J_H$, and $V_H$-$J_H$ junctions during the process of Ig gene rearrangement. In this respect, immunocompetence is reflected in the diversity of Igs.

Quantitative characterization of adaptive immune cells based on the presence in such cells of functionally rearranged Ig and TCR encoding genes that direct productive expression of adaptive immune receptors has been achieved using biological samples from which adaptive immune cells can be readily isolated in significant numbers, such as blood, lymph or other biological fluids. In these samples, adaptive immune cells occur as particles in fluid suspension. See, e.g., US 2010/0330571; see also, e.g., Murphy, *Janeway's Immunobiology* (8$^{th}$ Ed.), 2011 Garland Science, NY, Appendix I, pp. 717-762. Previous methods include quantification of the relative representation of adaptive immune cells in a sample by amplifying V-region polypeptides, J-region polypeptides, and an internal control gene from the sample, and comparing the number of cells containing V- and J-region polypeptides to the number of cells containing the internal control gene. See, e.g., U.S. Ser. No. 13/656,265. However, this method does not allow for absolute quantitation of the adaptive immune cells in the sample. Although a relative representation of the adaptive immune cells can be determined, current methods do not allow determination of the absolute number of adaptive immune cells in the input sample.

There is a need for a method that permits accurate absolute quantitation of adaptive immune cells in a complex biological sample. There is also a need for an improved method for quantifying a relative representation of adaptive immune cells in such a complex biological sample.

SUMMARY OF INVENTION

Disclosed herein are methods for quantifying a number of adaptive immune cells in a biological sample, and methods for quantifying a relative representation of adaptive immune cells in a biological sample that comprises a mixture of cells comprising adaptive immune cells and cells that are not adaptive immune cells.

In one embodiment, a method is provided for determining the ratio of T or B cells in a sample relative to the total number of input genomes. In one embodiment, the method provides amplifying by multiplex PCR and sequencing rearranged Tcell receptor loci (TCRs) from T cells or immunoglobulin (Ig) loci from V cells in a sample to obtain a total number of output biological sequences. In a further embodiment, methods are provided for amplifying by multiplex PCR and sequencing a first set of synthetic templates each comprising one TCR or Ig V segment and one TCR of Ig J or C segment and a unique bar code which identifies said synthetic template as synthetic. In one embodiment, each synthetic template comprises a unique combination of V and J or C segments. In a further embodiment the method provides determining an amplification factor that is represented by the total number of first synthetic templates amplified and sequenced divided by the total input number of unique first synthetic templates. In one embodiment, the method provides for determining the total number of T cells or B cells in the sample by dividing the total number of output biological sequences by the amplification factor.

In one embodiment the method further provides amplifying by multiplex PCR and sequencing one or more genomic control regions from DNA obtained from a sample to obtain the total number of output biological sequences for each genomic control region. In a further embodiment methods are provided for amplifying by multiplex PCR and sequencing a second set of synthetic templates, each comprising the sequence of one or more of said genomic control regions, a unique barcode and stretch of random nucleic acids. In one embodiment each synthetic template in the second set of synthetic templates is represented only once. In a further embodiment, the method provides for determining an amplification factor for each of the one or more genomic control regions by dividing the total number of second synthetic templates amplified and sequenced by the total input number of unique second synthetic templates. In one embodiment, the method further provides for a method for determining the total number of input genomes by dividing the total number of output biological sequences from each genomic control region by the corresponding amplification factor for that genomic control region. In yet another embodiment the methods provide for determining the ratio of T cells or B cells contained in the sample relative to the total genomes by dividing the total number to T cells or B cells in the sample by the total number of input genomes in the sample.

In one embodiment, the sample is obtained from a mammalian subject. In another embodiment, the sample comprises a mixture of cells comprising T cells and/or B cells and cells that are not Tc ells and/or B cells.

In one embodiment the method includes synthetic templates which comprise the sequence, 5'-U1-B1-V-B2-J-B3-U2-3'. In one embodiment, V is an oligonucleotide sequence comprising at least 20 and not more than 1000 contiguous nucleotides of a TCR or Ig variable (V) region encoding gene sequence or the complement thereof. In one embodiment, each synthetic template comprises a unique V region oligonucleotide sequence. In one embodiment, J is an oligonucleotide sequence comprising at least 15 and not more than 600 contiguous nucleotides of a TCR or Ig joining (J) region encoding gene sequence or the complement thereof. In one embodiment, U1 comprises an oligonucleotide sequence that is a first universal adaptor sequence or a first sequencing platform oligonucleotide sequence that is linked to and positioned 5' to a first universal adaptor oligonucleotide sequence. In a further embodiment, U2 comprises an oligonucleotide sequence that is a universal adaptor sequence or a second sequencing platform oligonucleotide sequence that is linked to and positioned 5' to a second universal adaptor oligonucleotide sequence. In one embodiment, B1, B2 and B3 are each independently, either nothing or an oligonucleotide barcode sequence of 3-25 nucleic acids that uniquely identifies as a pair combination a unique V region oligonucleotide sequence and a unique J region oligonucleotide. In one embodiment at least one B1, B2 and B3 is present in each synthetic template. In one embodiment at least two of B1, B2 and B3 are present in each synthetic template. In one embodiment all three of B1, B2 and B3 are present in each synthetic template. In one embodiment, the synthetic templates further comprise a string of random oligonucleotides (randomers). In one embodiment, the string of random oligonucleotides comprises about 4 to about 50 nucleotides. In one embodiment, the random stretch of oligonucleotides comprises about 8 oligonucleotides.

In one embodiment, the total number of synthetic templates in the first set of synthetic templates subject to amplification is used to determined using a limiting dilution of said synthetic templates each comprising a unique TCR of Ig V and J or C region such that the number of observed unique synthetic templates allows inference of the total number of input synthetic template molecules. In one embodiment, each synthetic template is found only in a single copy.

In one embodiment, the total number of synthetic templates in the first set of synthetic templates subject to amplification is determined by counting the number of unique synthetic templates based on unique random nucleotides contained in each synthetic template.

In one embodiment, the method provides for amplification of two or more genomic control regions. In another embodiment, the method provides for amplification of three or more genomic control regions. In yet another embodiment, the method provides for amplification of four or more genomic control regions. In still another embodiment, the method provides for amplification of five or more genomic control regions. In one embodiment, the method provides for amplification of five genomic control regions and calculating amplification factors for each. In one embodiment, the average amplification factor is determined by taking the average of amplification factors for each genomic control region. In one embodiment, the highest and lowest genomic control region amplification factor is discarded prior to taking an average. In one embodiment, the genomic control regions are one or more of ACTB, B2M, C1orf34, CHMP2A, GPI, GUSB, HMBS, HPRT1, PSMB4, RPL13A, RPLP0, SDHA, SNRPD#, UBC, VCP, VPS29, PPIA, PSMB2, RAB7A, UBC, VCP, REEP5 and EMC7. In one embodiment, the genomic control regions are PSMB2, RAB7A, PPIA, REEP5 and EMC7

In one embodiment, the multiplex PCR and sequencing of rearranged TCR or Ig loci and first synthetic templates are done in one multiplex PCR reaction while the amplification of the genomic control regions and second set of synthetic templates are done in a second multiplex PCR reaction. In another embodiment, the rearranged TCR and or Ig loci, the first set of synthetic templates, the genomic control regions and second set of synthetic templates are amplified and sequenced in the same multiplex PCR reaction.

In one embodiment, amplification of the rearranged TCR or Ig loci and first set of synthetic templates is done using a plurality of oligonucleotide primers. In one embodiment, the oligonucleotide primers comprise a plurality of V segment oligonucleotide primers that are each independently capable of specifically hybridizing to at least one polynucleotide encoding a TCR of Ig V region polypeptide or to the complement thereof. In one embodiment, each V segment primer comprises a nucleotide sequence of at least 15 contiguous nucleotides that is complementary to at least one functional a TCR or Ig V region encoding gene segment. In one embodiment, the plurality of V segment primers specifically hybridize to substantially all functional TCR or Ig V region encoding gene segments that are present in the composition. In one embodiment, the plurality of primers further includes a plurality of J segment oligonucleotide primers that are each independently capable of specifically hybridizing to at least one polynucleotide encoding a TCR or Ig J region polypeptide or to the complement thereof. In one embodiment, each J segment primer comprises a nucleotide sequence of at least 15 contiguous nucleotides that is complementary to at least one functional TCR or Ig J region encoding gene segment. In one embodiment, the plurality of J segment primers specifically hybridize to substantially all functional TCR or Ig J region encoding gene segments that are present in the composition.

In one embodiment, the plurality of V segment oligonucleotide primers and said plurality of J-segment oligonucleotide primers comprise the sequences set forth in SEQ ID NOs: 1-764. In one embodiment, the plurality of V segment oligonucleotide primers comprise sequences having at least 90% sequence identity to nucleotide sequences set forth in SEQ ID NOs: 1-120, 147-158, 167-276, 407-578, 593-740, and/or the plurality of J segment oligonucleotide primers comprise sequences having at least 90% sequence identity to nucleotide sequences set forth in SEQ ID NOs: 121-146, 159-166, 277-406, 579-592, or 741-764.

In one embodiment, the sample is fresh, frozen or fixed tissue. In one embodiment, the sample comprises human cells, mouse cells or rat cells. In one embodiment, the sample comprises somatic tissue.

In one embodiment, the sample is tumor biopsy. In one embodiment the TCR V segment comprises a TCR Vδ segment, a TCR Vγ segment, a TCR Vα segment, or a TCR Vβ segment. In one embodiment, the TCR J segment comprises a TCR Jδ segment, a TCR Jγ segment, a TCR Jα segment, or a TCR Jβ segment. In one embodiment, the Ig V segment comprises an IGH V gene segment, an IGL V gene segment, or an IGK V gene segment. In one embodiment, the Ig J region segment comprises an IGH J gene segment, an IGL J gene segment, or an IGK V gene segment.

In one embodiment, the biological output sequences for the TCR or Ig loci and the synthetic templates contained in the first set of synthetic templates are each about 100-300 nucleotides in length. In another embodiment, the output sequences for each genomic control region and the synthetic templates contained in the second set of synthetic templates are each about 100-300 nucleotides in length. In still another embodiment, the biological output sequences for the TCR or Ig loci, the synthetic templates contained in the first set of synthetic templates, the output sequences for each genomic control region and the synthetic templates contained in the second set of synthetic templates are each about 100-300 nucleotides in length.

In one embodiment, an amplification factor is determined for (i) a plurality of biological rearranged nucleic acid molecules encoding an adaptive immune receptor comprising a T-cell receptor (TCR) or Immunoglobulin (Ig) from said biological sample, each biological rearranged nucleic acid molecule comprising a unique variable (V) region encoding gene segment and a unique joining (J) region encoding gene segment, and (ii) a plurality of synthetic template oligonucleotide molecules, each comprising a paired combination of a unique V region gene segment and a unique J region gene segment found in one of the plurality of biological rearranged nucleic acid molecules.

In a further embodiment, determining the amplification factor includes comparing (1) a number of output synthetic template oligonucleotide sequences obtained from sequencing of amplified synthetic template oligonucleotide molecules generated from said multiplex PCR with (2) a number of input synthetic template oligonucleotide molecules added to said multiplex PCR, wherein said synthetic template oligonucleotide sequences comprise a sequence of formula I: 5'-U1-B1-V-B2-J-B3-U2-3' (I).

Within the synthetic template oligonucleotide sequence of formula I: V is an oligonucleotide sequence comprising at least 20 and not more than 1000 contiguous nucleotides of an adaptive immune receptor variable (V) region encoding gene sequence, or the complement thereof, and each of said plurality of synthetic template oligonucleotide sequences having a unique V-region oligonucleotide sequence, J is an oligonucleotide sequence comprising at least 15 and not more than 600 contiguous nucleotides of an adaptive immune receptor joining (J) region encoding gene sequence, or the complement thereof, and each of said plurality of synthetic template oligonucleotide sequences having a unique J-region oligonucleotide sequence, U1 comprises an oligonucleotide sequence that is selected from (i) a first universal adaptor oligonucleotide sequence and (ii) a first sequencing platform-specific oligonucleotide sequence that is linked to and positioned 5' to a first universal adaptor oligonucleotide sequence, U2 comprises an oligonucleotide sequence that is selected from (i) a second universal adaptor oligonucleotide sequence, and (ii) a second sequencing platform-specific oligonucleotide sequence that is linked to and positioned 5' to a second universal adaptor oligonucleotide sequence, and at least one of B1, B2, and B3 is present and each of B1, B2, and B3 comprises an oligonucleotide comprising a barcode sequence of 3-25 contiguous nucleotides that uniquely identifies, as a paired combination, (i) said unique V-region oligonucleotide sequence of (a) and (ii) said unique J-region oligonucleotide sequence of (b).

In a further embodiment, a total number of input biological rearranged nucleic acid molecules is determined by comparing the number of output sequences of biological rearranged nucleic acid molecules obtained from sequencing of amplified biological rearranged nucleic acid molecules produced from said multiplex PCR with said amplification factor. In still further embodiment, the relative representation of adaptive immune cells (in a biological sample comprising a mixture of cells comprising adaptive immune cells and cells that are not adaptive immune cells) is determined by comparing said number of input biological rearranged nucleic acid molecules with said number of total input biological nucleic acid molecules.

In some embodiments, determining said amplification factor comprises dividing (1) said number of output synthetic template oligonucleotide sequences obtained from sequencing of amplified synthetic template oligonucleotide molecules generated from the multiplex PCR by (2) said number of input synthetic template oligonucleotides added to said multiplex PCR. In other embodiments, determining a number of input biological rearranged nucleic acid molecules comprises dividing (1) a total number of output sequences of biological rearranged nucleic acid molecules obtained from sequencing of amplified biological rearranged nucleic acid molecules produced from said multiplex PCR by (2) said amplification factor. In still other embodiments, comparing said number of input biological rearranged nucleic acid molecules with said number of total input biological nucleic acid molecules comprises dividing number of input biological rearranged nucleic acid molecules by said the number of total input biological nucleic acid molecules.

In an embodiment, said number of input synthetic template oligonucleotides added in said multiplex PCR is determined by amplifying an undiluted synthetic template oligonucleotide pool using simplex PCR to obtain a plurality of synthetic template amplicons, sequencing said plurality of synthetic template amplicons to determine a frequency of each unique synthetic template oligonucleotide in the pool, quantifying a relationship based on in silico simulations of said frequency of each unique synthetic template oligonucleotide in the pool, between a total number of unique observed synthetic template oligonucleotide sequences in a subset of the pool and the number of total synthetic template oligonucleotides present in said subset, and determining a number of input total synthetic template oligonucleotides in said multiplex PCR, said multiplex PCR including a limiting dilution of said synthetic template oligonucleotide pool, said determination based on the number of unique synthetic template oligonucleotides observed in the sequencing output of said simplex PCR and on said quantified relationship. In a further embodiment, said number of input synthetic template oligonucleotides added in said multiplex PCR is further determined by adding a known quantity of said pool of diluted synthetic template oligonucleotides to said multiplex PCR to produce a number of amplified total synthetic template oligonucleotides.

In an embodiment, said multiplex PCR is performed using a plurality of oligonucleotide primer sets comprising: (a) a plurality of V segment oligonucleotide primers that are each independently capable of specifically hybridizing to at least one polynucleotide encoding an adaptive immune receptor V region polypeptide or to the complement thereof, wherein each V segment primer comprises a nucleotide sequence of at least 15 contiguous nucleotides that is complementary to at least one functional adaptive immune receptor V region encoding gene segment and wherein said plurality of V segment primers specifically hybridize to substantially all functional adaptive immune receptor V region encoding gene segments that are present in the composition, and (b) a plurality of J segment oligonucleotide primers that are each independently capable of specifically hybridizing to at least one polynucleotide encoding an adaptive immune receptor J region polypeptide or to the complement thereof, wherein each J segment primer comprises a nucleotide sequence of at least 15 contiguous nucleotides that is complementary to at least one functional adaptive immune receptor J region encoding gene segment and wherein said plurality of J segment primers specifically hybridize to substantially all functional adaptive immune receptor J region encoding gene segments that are present in the composition, such that said plurality of V segment and J segment oligonucleotide primers are capable of amplifying in said multiplex PCR: (i) substantially all synthetic template oligonucleotides to produce a plurality of amplified synthetic template oligonucleotide molecules, and (ii) substantially all biological rearranged nucleic acid molecules encoding adaptive immune receptors in said biological sample to produce a plurality of amplified biological rearranged nucleic acid molecules, said plurality of amplified biological rearranged nucleic acid molecules being sufficient to quantify diversity of said rearranged nucleic acid molecules from said biological sample. In a further embodiment, said plurality of V segment oligonucleotide primers and said plurality of J-segment oligonucleotide primers comprise the sequences set forth in SEQ ID NOs: 1-764.

In another embodiment, either one of both of: (i) said plurality of V segment oligonucleotide primers comprise sequences having at least 90% sequence identity to nucleotide sequences set forth in SEQ ID NOs: 1-120, 147-158, 167-276, 407-578, or 593-740, and (ii) said plurality of J segment oligonucleotide primers comprise sequences having at least 90% sequence identity to nucleotide sequences set forth in SEQ ID NOs: 121-146, 159-166, 277-406, 579-592, or 741-764. In some embodiments, said plurality of synthetic template oligonucleotide molecules comprises a number of at least a or at least b unique oligonucleotide sequences, whichever is larger, wherein a is the number of unique adaptive immune receptor V region-encoding gene segments in the subject and b is the number of unique adaptive immune receptor J region-encoding gene segments in the subject. In a further embodiment, a ranges from 1 to a number of maximum V gene segments in the genome of said mammalian subject. In a further embodiment, b ranges from 1 to a number of maximum J gene segments in the genome of said mammalian subject. In other embodiments, said plurality of synthetic template oligonucleotide molecules comprises at least one synthetic template oligonucleotide sequence for each unique V region oligonucleotide sequence and at least one synthetic template oligonucleotide sequence for each unique J region oligonucleotide sequence. In some embodiments, said adaptive immune cells are T cells or B cells. In other embodiments, said biological sample is fresh tissue, frozen tissue, or fixed tissue, and said biological sample comprises human cells, mouse cells, or rat cells. In further embodiments, said biological sample comprises somatic tissue.

In an embodiment, said V region encoding gene segment comprises a TCR Vδ segment, a TCR Vγ segment, a TCR Vα segment, or a TCR Vβ segment. In another embodiment, said J region encoding gene segment comprises a TCR Jδ segment, a TCR Jγ segment, a TCR Jα segment, or a TCR Jβ segment. In some embodiments, said V region encoding gene segment comprises an IGH V gene segment, an IGL V gene segment, or an IGK V gene segment. In other embodiments, said J region encoding gene segment comprises an IGH J gene segment, an IGL J gene segment, or an IGK V gene segment. In some embodiments, said plurality of synthetic template oligonucleotide sequences comprise sequences selected from SEQ ID NOs: 787-3003. In other embodiments, V of formula (I) is an oligonucleotide sequence comprising at least 30, 60, 90, 120, 150, 180, or 210, or not more than 900, 800, 700, 600, or 500 contiguous nucleotides of an adaptive immune receptor V region encoding gene sequence, or the complement thereof. In other embodiments, J of formula (I) is an oligonucleotide sequence comprising at least 16-30, 31-60, 61-90, 91-120, or 120-150, or not more than 500, 400, 300, or 200 contiguous nucleotides of an adaptive immune receptor J region encoding gene sequence, or the complement thereof.

In some embodiments, J of formula (I) comprises a sequence comprising a constant region of J region encoding gene sequence. In other embodiments, each synthetic template oligonucleotide sequence is less than 1000, 900, 800, 700, 600, 500, 400, 300 or 200 nucleotides in length.

Also disclosed herein are kits comprising reagents comprising a composition comprising a plurality of synthetic template oligonucleotides and a set of oligonucleotide primers as described above, and instructions for quantifying a relative representation of adaptive immune cells in a biological sample that comprises a mixture of cells comprising adaptive immune cells and cells that are not adaptive immune cells, by quantifying: (i) a synthetic template product number of amplified synthetic template oligonucleotide molecules, and (ii) a biological rearranged product number of a number of output sequences.

BRIEF DESCRIPTIONS OF THE DRAWINGS

These and other features, aspects, and advantages of the present invention will become better understood with regard to the following description, and accompanying drawings, where:

DETAILED DESCRIPTION OF THE INVENTION

Overview

Figures 1A, 1B:
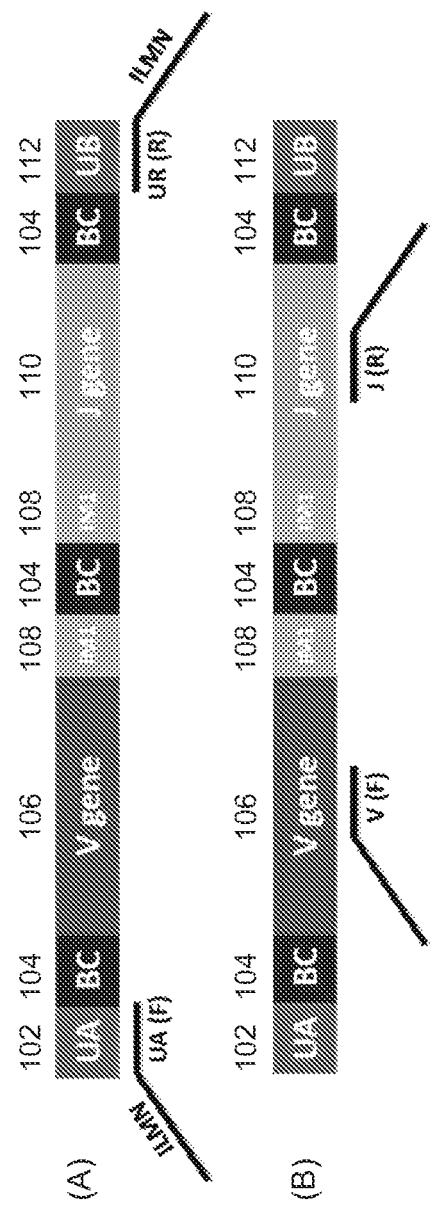
FIGS. 1A and 1B illustrate examples of synthetic template oligonucleotides, according to one embodiment of the invention. Primers with Illumina (ILMN) sequencing tails are shown, specific for the universal adaptor sequences (above) or the V gene and J gene sequences (below).

Methods and compositions are provided for determining the absolute number of input genomes from adaptive immune cells in a complex mixture of cells. In addition, the present disclosure relates to methods for quantitative determination of lymphocyte presence in complex tissues, such as solid tissues. The methods of the invention also include a quantification of the relative representation of tumor-infiltrating lymphocyte (TIL) genomes as a relative proportion of all cellular genomes that are represented in a sample, such as a solid tissue or solid tumor sample, or quantification of the genomes of lymphocytes that have infiltrated somatic tissue in the pathogenesis of inflammation, allergy or autoimmune disease or in transplanted organs as a relative proportion of all cellular genomes that are represented in a tissue DNA sample.

In some embodiments, the method includes determining the accurate absolute quantification of the number of adaptive immune cells in a biological sample. This involves determining the number of input genomes from adaptive immune cells in the sample.

Further provided herein are compositions and methods that are useful for reliably quantifying and determining the sequences of large and structurally diverse populations of rearranged genes encoding adaptive immune receptors, such as immunoglobulins (IG) and/or T cell receptors (TCR). These rearranged genes may be present in a biological sample containing DNA from lymphoid cells of a subject or biological source, including a human subject, and/or mRNA transcripts of these rearranged genes may be present in such a sample and used as templates for cDNA synthesis by reverse transcription.

Methods are provided for quantifying an amount of synthetic template oligonucleotides in a sample to determine a total number of input genomes from adaptive immune cells in a biological sample. In one embodiment, a sample of synthetic template oligonucleotides is used to determine a ratio of the number of input synthetic template oligonucleotide molecules compared with the number of total output (amplicon) synthetic template oligonucleotides. A limiting dilution of this sample is spiked-in to a biological sample (at the start of a multiplex PCR assay) and used to determine the total number of input genomes from adaptive immune cells in the biological sample. In certain embodiments, the synthetic templates in the sample comprise a stretch of random nucleic acids, for example an 8 nucleotide randomer. Therefore, limiting dilutions can be made such that each synthetic template in the sample is present only once and can be identified by the 8 nucleotide randomer contained therein.

The method also includes determining the relative representation of adaptive immune cells in a sample that contains a mixture of cells, where the mixture comprises adaptive immune cells and cells that are not adaptive immune cells. In certain embodiments, a relative representation of DNA from adaptive immune cells (e.g., T and/or B lymphocytes having rearranged adaptive immune receptor genes, including T- and B-lineage cells of different maturational stages such as precursors, blast cells, progeny or the like) among total DNA from a sample of mixed cell types can be quantified. For instance, certain embodiments permit determination, in DNA extracted from a biological sample, of the relative representation of DNA from tumor infiltrating lymphocytes (TIL) in the DNA from the biological sample, where the sample comprises all or a portion of a tumor that contains adaptive immune cells and cells that are not adaptive immune cells (including tumor cells). Certain other embodiments, for example, permit determination, in DNA extracted from a biological sample, of the relative representation of DNA from infiltrating lymphocytes in the DNA from the biological sample, where the sample comprises all or a portion of a somatic tissue that contains adaptive immune cells and cells that are not adaptive immune cells, such as cells of a solid tissue. Alternative methods of quantifying the relative representation of adaptive immune cells in a mixture of cells are disclosed in U.S. Ser. No. 13/656,265, filed on Oct. 21, 2012, and International App. No. PCT/US2012/061193, filed on Oct. 21, 2012, which are hereby incorporated by reference in their entireties.

The cells in the mixture of cells may not all be adaptive immune cells, and certain unforeseen advantages of the herein described embodiments are obtained where the cells in the mixture of cells need not all be adaptive immune cells. As described herein, compositions and methods are provided for quantifying the proportion of cellular genomes in a sample comprising nucleic acid molecules (e.g., DNA) that are contributed by adaptive immune cells relative to the total number of cellular genomes in the sample, starting from a DNA sample that has been extracted from a mixture of cell types, such as a solid tumor or a solid tissue.

In certain embodiments, rearranged adaptive immune receptor nucleic acid molecules are amplified in a single multiplex PCR using rearranged adaptive immune receptor-specific oligonucleotide primer sets to produce adaptive immune cell-specific DNA sequences, which are used to determine the relative contribution of adaptive immune cells as compared to the total DNA extracted from a sample of mixed cell types. In other embodiments, rearranged adaptive immune cell mRNA molecules are amplified using rt-qPCR and rearranged adaptive immune receptor-specific oligonucleotide primer sets to quantify rearranged adaptive immune receptor cDNA signals and to determine the relative contribution of adaptive immune cells to the total number of genomes extracted from a sample of mixed cell types. Methods of using qPCR to determine the relative representation of adaptive immune cells in a mixture of cells are disclosed in U.S. Ser. No. 13/656,265, filed on Oct. 21, 2012, and International App. No. PCT/US2012/061193, filed on Oct. 21, 2012, which are hereby incorporated by reference in their entireties.

Furthermore, in other embodiments, where the sample includes mRNA molecules, methods of the invention include using a real time quantitative polymerase chain reaction (qPCR) assay with oligonucleotide primer sets that specifically amplify substantially all rearranged adaptive immune receptor genes (e.g., CDR3 encoding polynucleotide-containing portions of rearranged T cell receptor and/or immunoglobulin genes) that may be present in a sample, to generate a first detectable DNA signal that quantitatively reflects the production of a multiplicity of amplified rearranged adaptive immune receptor encoding DNA molecules. In certain embodiments, qPCR amplification may be monitored at one or a plurality of time points during the course of the qPCR reaction, i.e., in "real time". Real-time monitoring permits determination of the quantity of DNA that is being generated by comparing a so-measured adaptive immune receptor-encoding DNA-quantifying signal to an appropriate synthetic template (or control template DNA) quantifying signal, which may be used as a calibration standard. Methods for quantification using qPCR are described in detail in U.S. application Ser. No. 13/656,265, filed on Oct. 21, 2012, International App. No. PCT/US2012/061193, filed on Oct. 21, 2012, which are each incorporated by reference in their entireties.

Further disclosed herein are unexpectedly advantageous approaches for determining the relative representation of adaptive immune cells in a biological sample using multiplex PCR to generate a population of amplified DNA molecules from a biological sample containing rearranged genes encoding adaptive immune receptors, prior to quantitative high throughput sequencing of such amplified products. Multiplexed amplification and high throughput sequencing of rearranged TCR and BCR (IG) encoding DNA sequences are described, for example, in Robins et al., 2009 Blood 114, 4099; Robins et al., 2010 Sci. Translat. Med. 2:47ra64; Robins et al., 2011 J. Immunol. Meth. doi:10.1016/j.jim.2011.09.001; Sherwood et al. 2011 Sci. Translat. Med. 3:90ra61; U.S. Ser. No. 13/217,126 (US Pub. No. 2012/0058902), U.S. Ser. No. 12/794,507 (US Pub. No. 2010/0330571), WO/2010/151416, WO/2011/106738 (PCT/US2011/026373), WO2012/027503 (PCT/US2011/049012), U.S. Ser. No. 61/550,311, WO/2013/169957 (PCT/US2013/040221), WO/2013/188831 (PCT/US2013/045994), and U.S. Ser. No. 61/569,118; accordingly these disclosures are incorporated by reference and may be adapted for use according to the embodiments described herein.

Further described herein, in certain embodiments, are compositions and methods for the use of synthetic template oligonucleotides that are intended to be directly included in amplification and sequencing reactions of a sample, and whose quantity in the reaction (the number of molecules) can be precisely measured to improve the accuracy of multiplex PCR amplification bias correction and absolute input template quantitation. Amplification bias is described further in WO/2013/169957 (PCT/US2013/040221) and Carlson, C. S. et al. Using synthetic templates to design an unbiased multiplex PCR assay, Nature Communications 4, 2680, doi: 10.1038/ncomms3680 (2013), both of which are each incorporated by reference in its entirety.

The present invention is directed in certain embodiments as described herein to quantification of DNA from adaptive immune cells that are present in solid tissues, and in particular embodiments, to solid tumors, such that the relative presence of adaptive immune cells as a proportion of all cell types that may be present in the tissue (e.g., tumor) can be determined. These and related embodiments are in part a result of certain surprising and heretofore unrecognized advantages, disclosed in greater detail below, that derive from exquisite sensitivity that is afforded, for the detection of adaptive immune cells, by the design of multiplex PCR using the herein described oligonucleotide primer sets. These oligonucleotide primer sets permit production of amplified rearranged DNA molecules and synthetic template molecules that encode portions of adaptive immune receptors. These and related embodiments feature the selection of a plurality of oligonucleotide primers that specifically hybridize to adaptive immune receptor (e.g., T cell receptor, TCR; or immunoglobulin, Ig) V-region polypeptide encoding polynucleotide sequences and J-region polypeptide encoding polynucleotide sequences. The invention includes universal primers that are specific to universal adaptor sequences and bind to amplicons comprising universal adaptor sequences. The primers promote PCR amplification of nucleic acid molecules, such as DNA, that include substantially all rearranged TCR CDR3-encoding or Ig CDR3-encoding gene regions that may be present in a test biological sample, where the sample contains a mixture of cells which comprises adaptive immune cells (e.g., T- and B-lymphocyte lineage cells) and cells that are not adaptive immune cells. For example, a cell mixture may be obtained from a solid tumor that comprises tumor cells and TILs.

Adaptive Immune Cell Receptors

The native TCR is a heterodimeric cell surface protein of the immunoglobulin superfamily, which is associated with invariant proteins of the CD3 complex involved in mediating signal transduction. TCRs exist in αβ and γδ forms, which are structurally similar but have quite distinct anatomical locations and probably functions. The MHC class I and class II ligands, which bind to the TCR, are also immunoglobulin superfamily proteins but are specialized for antigen presentation, with a highly polymorphic peptide binding site which enables them to present a diverse array of short peptide fragments at the APC cell surface.

The extracellular portions of native heterodimeric αβ and γδ TCRs consist of two polypeptides each of which has a membrane-proximal constant domain, and a membrane-distal variable domain. Each of the constant and variable domains includes an intra-chain disulfide bond. The variable domains contain the highly polymorphic loops analogous to the complementarity determining regions (CDRs) of antibodies. CDR3 of αβ TCRs interact with the peptide presented by MHC, and CDRs 1 and 2 of αβ TCRs interact with the peptide and the MHC. The diversity of TCR sequences is generated via somatic rearrangement of linked variable (V), diversity (D), joining (J), and constant genes.

The Ig and TCR gene loci contain many different variable (V), diversity (D), and joining (J) gene segments, which are subjected to rearrangement processes during early lymphoid differentiation. Ig and TCR V, D and J gene segment sequences are known in the art and are available in public databases such as GENBANK. The V-D-J rearrangements are mediated via a recombinase enzyme complex in which the RAG1 and RAG2 proteins play a key role by recognizing and cutting the DNA at the recombination signal sequences (RSS). The RSS are located downstream of the V gene segments, at both sides of the D gene segments, and upstream of the J gene segments. Inappropriate RSS reduce or even completely prevent rearrangement. The RSS consists of two conserved sequences (heptamer, 5'-CACAGTG-3', and nonamer, 5'-ACAAAAACC-3'), separated by a spacer of either 12+/−1 bp ("12-signal") or 23+/−1 bp ("23-signal"). A number of nucleotide positions have been identified as important for recombination, including the CA dinucleotide at position one and two of the heptamer, and a C at heptamer position three has also been shown to be strongly preferred as well as an A nucleotide at positions 5, 6, 7 of the nonamer. (Ramsden et al. 1994 *Nucl. Ac. Res.* 22:1785; Akamatsu et al. 1994 *J. Immunol.* 153:4520; Hesse et al. 1989 *Genes Dev.* 3:1053). Mutations of other nucleotides have minimal or inconsistent effects. The spacer, although more variable, also has an impact on recombination, and single-nucleotide replacements have been shown to significantly impact recombination efficiency (Fanning et al. 1996 *Cell. Immunol. Immumnopath.* 79:1, Larijani et al. 1999 *Nucl. Ac. Res.* 27:2304; Nadel et al. 1998 *J. Immunol.* 161:6068; Nadel et al. 1998 *J. Exp. Med.* 187:1495). Criteria have been described for identifying RSS polynucleotide sequences having significantly different recombination efficiencies (Ramsden et al. 1994 *Nucl. Ac. Res.* 22:1785; Akamatsu et al. 1994 *J. Immunol.* 153:4520; Hesse et al. 1989 *Genes Dev.* 3:1053, and Lee et al., 2003 *PLoS* 1(1):E1).

The rearrangement process generally starts with a D to J rearrangement followed by a V to D-J rearrangement in the case of Ig heavy chain (IgH), TCR beta (TCRB), and TCR delta (TCRD) genes or concerns direct V to J rearrangements in case of Ig kappa (IgK), Ig lambda (IgL), TCR alpha (TCRA), and TCR gamma (TCRG) genes. The sequences between rearranging gene segments are generally deleted in the form of a circular excision product, also called TCR excision circle (TREC) or B cell receptor excision circle (BREC).

The many different combinations of V, D, and J gene segments represent the so-called combinatorial repertoire, which is estimated to be ~$2\times10^6$ for Ig molecules, ~$3\times10^6$ for TCRαβ and ~$5\times10^3$ for TCRγδ molecules. At the junction sites of the V, D, and J gene segments, deletion and random insertion of nucleotides occurs during the rearrangement process, resulting in highly diverse junctional regions, which significantly contribute to the total repertoire of Ig and TCR molecules, estimated to be >$10^{12}$.

Mature B-lymphocytes further extend their Ig repertoire upon antigen recognition in follicle centers via somatic hypermutation, a process, leading to affinity maturation of the Ig molecules. The somatic hypermutation process focuses on the V- (D-) J exon of IgH and Ig light chain genes and concerns single nucleotide mutations and sometimes also insertions or deletions of nucleotides. Somatically-mutated Ig genes are also found in mature B-cell malignancies of follicular or post-follicular origin.

Definitions

As used herein, the term "gene" refers to a segment of DNA that can be expressed as a polypeptide chain. The polypeptide chain can be all or a portion of a TCR or Ig polypeptide (e.g., a CDR3-containing polypeptide). The gene can include regions preceding and following the coding region ("leader and trailer"), intervening sequences (introns) between individual coding segments (exons), regulatory elements (e.g., promoters, enhancers, repressor binding sites and the like), and recombination signal sequences (RSS's), as described herein.

The "nucleic acids" or "nucleic acid molecules" or "polynucleotides" or "oligonucleotides" can be in the form of ribonucleic acids (RNA), or in the form of deoxyribonucleic acids (DNA). As referred to herein, RNA includes mRNA. DNA includes cDNA, genomic DNA, and synthetic DNA. The DNA can be double-stranded or single-stranded, and if single stranded may be the coding strand or non-coding (anti-sense) strand. A coding sequence which encodes a TCR or an immunoglobulin or a region thereof (e.g., a V region, a D segment, a J region, a C region, etc.) can be identical to the coding sequence known in the art for any given TCR or immunoglobulin gene regions or polypeptide domains (e.g., V-region domains, CDR3 domains, etc.). In other embodiments, the coding sequence can be a different coding sequence, which, as a result of the redundancy or degeneracy of the genetic code, encodes the same TCR or immunoglobulin region or polypeptide.

The term "primer," as used herein, refers to an oligonucleotide capable of acting as a point of initiation of DNA synthesis under suitable conditions. Such conditions include those in which synthesis of a primer extension product complementary to a nucleic acid strand is induced in the presence of four different nucleoside triphosphates and an agent for extension (e.g., a DNA polymerase or reverse transcriptase) in an appropriate buffer and at a suitable temperature.

A primer is preferably a single-stranded DNA. The appropriate length of a primer depends on the intended use of the primer but typically ranges from 6 to 50 nucleotides, or in certain embodiments, from 15-35 nucleotides. Short primer molecules generally require cooler temperatures to form sufficiently stable hybrid complexes with the template. A primer need not reflect the exact sequence of the template nucleic acid, but must be sufficiently complementary to hybridize with the template. The design of suitable primers for the amplification of a given target sequence is well known in the art and described in the literature cited herein.

As described herein, primers can incorporate additional features which allow for the detection or immobilization of the primer but do not alter the basic property of the primer, that of acting as a point of initiation of DNA synthesis. For example, primers may contain an additional nucleic acid sequence at the 5' end which does not hybridize to the target nucleic acid, but which facilitates cloning, detection, or sequencing of the amplified product. The region of the primer which is sufficiently complementary to the template to hybridize is referred to herein as the hybridizing region.

As used herein, a primer is "specific," for a target sequence if, when used in an amplification reaction under sufficiently stringent conditions, the primer hybridizes primarily to the target nucleic acid. Typically, a primer is specific for a target sequence if the primer-target duplex stability is greater than the stability of a duplex formed between the primer and any other sequence found in the sample. One of skill in the art will recognize that various factors, such as salt conditions as well as base composition of the primer and the location of the mismatches, will affect the specificity of the primer, and that routine experimental confirmation of the primer specificity will be needed in many cases. Hybridization conditions can be chosen under which the primer can form stable duplexes only with a target sequence. Thus, the use of target-specific primers under suitably stringent amplification conditions enables the selective amplification of those target sequences which contain the target primer binding sites.

The term "ameliorating" refers to any therapeutically beneficial result in the treatment of a disease state, e.g., a cancer stage, an autoimmune disease state, including prophylaxis, lessening in the severity or progression, remission, or cure thereof.

The term "in vivo" refers to processes that occur in a living organism.

The term "mammal" as used herein includes both humans and non-humans and include but is not limited to humans, non-human primates, canines, felines, murines, bovines, equines, and porcines.

The term percent "identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent "identity" can exist over a region of the sequence being compared, e.g., over a functional domain, or, alternatively, exist over the full length of the two sequences to be compared.

For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., infra).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information (www.ncbi.nlm.nih.gov/).

It must be noted that, as used in the specification and the appended claims, the singular forms "a," "an" and "the" include plural referents unless the context clearly dictates otherwise.

Samples (Tissues and Use)

As used herein, a sample, test sample or test biological sample refer to biological tissues (e.g., an aggregate of cells that have similar structure and function) obtained from a subject of interest. The sample can include a complex mixture of adaptive immune cells (e.g., T- and B-lymphocyte lineage cells) and cells that are not adaptive immune cells (e.g., solid tumor cells).

In certain embodiments, a test biological sample of interest comprises somatic tissue. The somatic tissue can comprise a solid tissue. In some embodiments, the solid tissue can be a site for autoimmune disease pathology, such as a tissue that is inappropriately targeted by a host's immune system for an "anti-self" immune response. In certain other embodiments, the somatic tissue can comprise a solid tissue that is a site of an infection, such as a bacterial, yeast, viral or other microbial infection (e.g., a Herpes Simplex Virus (HSV) infection). In yet other embodiments, the somatic tissue is obtained from a transplanted organ (e.g., a transplanted liver, lung, kidney, heart, spleen, pancreas, skin, intestine and thymus).

Samples can be obtained from tissues prior to, during, and/or post treatment. Samples can be used in diagnostic, prognostic, disease monitoring, therapeutic efficacy monitoring and other contexts, thereby providing important information, such as quantification of adaptive immune cell representation in complex tissues comprising a mixture of cells. Adaptive immune cell quantification (e.g., quantification of the relative representation of adaptive immune cells in samples) or adaptive immune cell DNA quantification (e.g., quantification of the relative representation of adaptive immune cell DNA in samples that contain DNA from a mixture of cells) in tissues before and after, and/or during the course of treatment of a subject, can provide information of relevance to the diagnosis and prognosis in patients with cancer, inflammation and/or autoimmune disease, or any of a number of other conditions that may be characterized by alterations (e.g., statistically significant increases or decreases) in adaptive immune cell presence in one or more tissues.

In some embodiments, the sample is obtained from a solid tumor in a subject. Multiple samples can be obtained prior to, during and/or following administration of a therapeutic regimen to the subject. A sample can be obtained, for example, by excision of tissue from a pre- or post-treatment subject.

In other embodiments, the sample comprising tissue is evaluated or analyzed according to other art-accepted criteria. Indicators of status (e.g., evidence of presence or absence of pathology, or of efficacy of a previously or contemporaneously administered therapeutic treatment) can be, for example, detectable indicator compounds, nanoparticles, nanostructures or other compositions that comprise a reporter molecule which provides a detectable signal indicating the physiological status of a cell or tissue, such as a vital dye (e.g., Trypan blue), a colorimetric pH indicator, a fluorescent compound that may exhibit distinct fluorescence as a function of any of a number of cellular physiological parameters (e.g., pH, intracellular $Ca^{2+}$ or other physiologically relevant ion concentration, mitochondrial membrane potential, plasma membrane potential, etc., see Haugland, *The Handbook: A Guide to Fluorescent Probes and Labeling Technologies* ($10^{th}$ Ed.) 2005, Invitrogen Corp., Carlsbad, Calif.), an enzyme substrate, a specific oligonucleotide probe, a reporter gene, or the like.

Subjects and Source

The subject or biological source, from which a test biological sample may be obtained, may be a human or non-human animal, or a transgenic or cloned or tissue-engineered (including through the use of stem cells) organism. In certain preferred embodiments of the invention, the subject or biological source may be known to have, or may be suspected of having or being at risk for having, a solid tumor or other malignant condition, or an autoimmune disease, or an inflammatory condition, and in certain preferred embodiments of the invention the subject or biological source may be known to be free of a risk or presence of such disease.

Certain preferred embodiments contemplate a subject or biological source that is a human subject such as a patient that has been diagnosed as having or being at risk for developing or acquiring cancer according to art-accepted clinical diagnostic criteria, such as those of the U.S. National Cancer Institute (Bethesda, Md., USA) or as described in *DeVita, Hellman, and Rosenberg's Cancer: Principles and Practice of Oncology* (2008, Lippincott, Williams and Wilkins, Philadelphia/Ovid, N.Y.); Pizzo and Poplack, *Principles and Practice of Pediatric Oncology* (Fourth edition, 2001, Lippincott, Williams and Wilkins, Philadelphia/Ovid, N.Y.); and Vogelstein and Kinzler, *The Genetic Basis of Human Cancer* (Second edition, 2002, McGraw Hill Professional, New York); certain embodiments contemplate a human subject that is known to be free of a risk for having, developing or acquiring cancer by such criteria.

Certain embodiments contemplate a non-human subject or biological source, including, but not limited to, a non-human primate, such as a macaque, chimpanzee, gorilla, vervet, orangutan, baboon, or other non-human primate, including such non-human subjects that may be known to the art as preclinical models, including preclinical models for solid tumors and/or other cancers. Certain other embodiments contemplate a non-human subject that is a mammal, for example, a mouse, rat, rabbit, pig, sheep, horse, bovine, goat, gerbil, hamster, guinea pig or other mammal. Many such mammals may be subjects that are known to the art as preclinical models for certain diseases or disorders, including solid tumors and/or other cancers (e.g., Talmadge et al., 2007 *Am. J. Pathol.* 170:793; Kerbel, 2003 *Canc. Biol. Therap.* 2(4 Suppl 1):S134; Man et al., 2007 *Canc. Met. Rev.* 26:737; Cespedes et al., 2006 *Clin. Transl. Oncol.* 8:318). The range of embodiments is not intended to be so limited, however, such that there are also contemplated other embodiments in which the subject or biological source can be a non-mammalian vertebrate, for example, another higher vertebrate, or an avian, amphibian or reptilian species, or another subject or biological source.

Biological samples can be provided by obtaining a blood sample, biopsy specimen, tissue explant, organ culture, biological fluid or any other tissue or cell preparation from a subject or a biological source. In certain preferred embodiments, a test biological sample can be obtained from a solid tissue (e.g., a solid tumor), for example by surgical resection, needle biopsy or other means for obtaining a test biological sample that contains a mixture of cells.

Solid tissues are well known to the medical arts and can include any cohesive, spatially discrete non-fluid defined anatomic compartment that is substantially the product of multicellular, intercellular, tissue and/or organ architecture, such as a three-dimensionally defined compartment that may comprise or derive its structural integrity from associated connective tissue and may be separated from other body areas by a thin membrane (e.g., meningeal membrane, pericardial membrane, pleural membrane, mucosal membrane, basement membrane, omentum, organ-encapsulating membrane, or the like). Non-limiting exemplary solid tissues can include brain, liver, lung, kidney, prostate, ovary, spleen, lymph node (including tonsil), skin, thyroid, pancreas, heart, skeletal muscle, intestine, larynx, esophagus and stomach. Anatomical locations, morphological properties, histological characterization, and invasive and/or non-invasive access to these and other solid tissues are all well known to those familiar with the relevant arts.

Solid tumors of any type are contemplated as being suitable for characterization of TIL using the compositions and methods described herein. In certain preferred embodiments, the solid tumor can be a benign tumor or a malignant tumor, which can further be a primary tumor, an invasive tumor or a metastatic tumor. Certain embodiments contemplate a solid tumor that comprises one of a prostate cancer cell, a breast cancer cell, a colorectal cancer cell, a lung cancer cell, a brain cancer cell, a renal cancer cell, a skin cancer cell (such as squamous cell carcinoma, basal cell carcinoma, or melanoma) and an ovarian cancer cell, but the invention is not intended to be so limited and other solid tumor types and cancer cell types may be used. For example, the tumor may comprise a cancer selected from adenoma, adenocarcinoma, squamous cell carcinoma, basal cell carcinoma, melanoma (e.g., malignant melanoma), small cell carcinoma, large cell undifferentiated carcinoma, chondrosarcoma and fibrosarcoma, or the like. As also noted elsewhere herein, art-accepted clinical diagnostic criteria have been established for these and other cancer types, such as those promulgated by the U.S. National Cancer Institute (Bethesda, Md., USA) or as described in *DeVita, Hellman, and Rosenberg's Cancer: Principles and Practice of Oncology* (2008, Lippincott, Williams and Wilkins, Philadelphia/Ovid, N.Y.); Pizzo and Poplack, *Principles and Practice of Pediatric Oncology* (Fourth edition, 2001, Lippincott, Williams and Wilkins, Philadelphia/Ovid, N.Y.); and Vogelstein and Kinzler, *The Genetic Basis of Human* Cancer (Second edition, 2002, McGraw Hill Professional, New York). Other non-limiting examples of typing and characterization of particular cancers are described, e.g., in Ignatiadis et al. (2008 *Pathobiol.* 75:104); Kunz (2008 *Curr. Drug Discov. Technol.* 5:9); and Auman et al. (2008 *Drug Metab. Rev.* 40:303).

B cells and T cells can be obtained from a biological sample, such as from a variety of tissue and biological fluid samples including bone marrow, thymus, lymph glands, lymph nodes, peripheral tissues and blood, but peripheral blood is most easily accessed. Any peripheral tissue can be sampled for the presence of B and T cells and is therefore contemplated for use in the methods described herein. Tissues and biological fluids from which adaptive immune cells can be obtained include, but are not limited to, skin, epithelial tissues, colon, spleen, a mucosal secretion, oral mucosa, intestinal mucosa, vaginal mucosa or a vaginal secretion, cervical tissue, ganglia, saliva, cerebrospinal fluid (CSF), bone marrow, cord blood, serum, serosal fluid, plasma, lymph, urine, ascites fluid, pleural fluid, pericardial fluid, peritoneal fluid, abdominal fluid, culture medium, conditioned culture medium or lavage fluid. In certain embodiments, adaptive immune cells can be isolated from an apheresis sample. Peripheral blood samples may be obtained by phlebotomy from subjects. Peripheral blood mononuclear cells (PBMCs) are isolated by techniques known to those of skill in the art, e.g., by Ficoll-Hypaque® density gradient separation. In certain embodiments, whole PBMCs are used for analysis.

In certain related embodiments, samples that comprise predominantly lymphocytes (e.g., T and B cells) or that comprise predominantly T cells or predominantly B cells, can be prepared for use as provided herein, according to established, art-accepted methodologies.

In other related embodiments, specific subpopulations of T or B cells can be isolated prior to analysis, using the methods described herein. Various methods and commercially available kits for isolating different subpopulations of T and B cells are known in the art and include, but are not limited to, subset selection immunomagnetic bead separation or flow immunocytometric cell sorting using antibodies specific for one or more of any of a variety of known T and B cell surface markers. Illustrative markers include, but are not limited to, one or a combination of CD2, CD3, CD4, CD8, CD14, CD19, CD20, CD25, CD28, CD45RO, CD45RA, CD54, CD62, CD62L, CDw137 (41BB), CD154, GITR, FoxP3, CD54, and CD28. For example, as known to a skilled person in the art, cell surface markers, such as CD2, CD3, CD4, CD8, CD14, CD19, CD20, CD45RA, and CD45RO can be used to determine T, B, and monocyte lineages and subpopulations using flow cytometry. Similarly, forward light-scatter, side-scatter, and/or cell surface markers, such as CD25, CD62L, CD54, CD137, and CD154, can be used to determine activation state and functional properties of cells.

Illustrative combinations useful in certain of the methods described herein can include $CD8^+CD45RO^+$ (memory cytotoxic T cells), $CD4^+CD45RO^+$ (memory T helper), $CD8^+CD45RO^-$ ($CD8^+CD62L^+CD45RA^+$ (naïve-like cytotoxic T cells); $CD4^+CD25^+CD62L^{hi}GITR^+FoxP3^+$ (regulatory T cells). Illustrative antibodies for use in immunomagnetic cell separations or flow immunocytometric cell sorting include fluorescently labeled anti-human antibodies, e.g., CD4 FITC (clone M-T466, Miltenyi Biotec), CD8 PE (clone RPA-T8, BD Biosciences), CD45RO ECD (clone UCHL-1, Beckman Coulter), and CD45RO APC (clone UCHL-1, BD Biosciences). Staining of cells can be done with the appropriate combination of antibodies, followed by washing cells before analysis. Lymphocyte subsets can be isolated by fluorescence activated cell sorting (FACS), e.g., by a BD FACSAria™ cell-sorting system (BD Biosciences) and by analyzing results with FlowJo™ software (Treestar Inc.), and also by conceptually similar methods involving specific antibodies immobilized to surfaces or beads.

For nucleic acid extraction, total genomic DNA can be extracted from cells using methods known in the art and/or commercially available kits, e.g., by using the QIAamp® DNA blood Mini Kit (QIAGEN®). The approximate mass of a single haploid genome is 3 picograms (pg). In some embodiments, a single diploid genome is approximately 6.5 picograms. In an embodiment, the absolute number of T cells can be estimated by assuming one total cell of input material per 6.5 picograms of genomic data. In some embodiments, at least 100,000 to 200,000 cells are used for analysis, i.e., about 0.6 to 1.2 μg DNA from diploid T or B cells.

Multiplex PCR

As described herein, there is provided a method for quantifying the relative representation of adaptive immune cell DNA in DNA from a test biological sample of mixed cell types, and thus for estimating the relative number of T or B cells in a complex mixture of cells. According to certain embodiments, the method for quantifying the relative representation of adaptive immune cell DNA in a complex mixture of cells involves a multiplex PCR method using a set of forward primers that specifically hybridize to the V segments and a set of reverse primers that specifically hybridize to the J segments, where the multiplex PCR reaction allows amplification of all the possible VJ (and VDJ) combinations within a given population of T or B cells. In some embodiments, the multiplex PCR method includes using the set of forward V-segment primers and set of reverse J-segment primers to amplify a given population of synthetic template oligonucleotides comprising the VJ and VDJ combinations. Because the multiplex PCR reaction amplifies substantially all possible combinations of V and J segments, it is possible to determine, using multiplex PCR, the relative number of T cell or B cell genomes in a sample comprising a mixed population of cells.

Nucleic Acid Extraction

In one embodiment, total genomic DNA can be extracted from cells using standard methods known in the art and/or commercially available kits, e.g., by using the QIAamp® DNA blood Mini Kit (QIAGEN®). The approximate mass of a single haploid genome is 3 pg. Preferably, at least 100,000 to 200,000 cells are used for analysis of diversity, i.e., about 0.6 to 1.2 μg DNA from diploid T or B cells.

Alternatively, total nucleic acid can be isolated from cells, including both genomic DNA and mRNA. If diversity is to be measured from mRNA in the nucleic acid extract, the mRNA must be converted to cDNA prior to measurement.

This can readily be done by methods of one of ordinary skill, for example, using reverse transcriptase according to known procedures.

In some embodiments, DNA or mRNA can be extracted from a sample comprising a mixed population of cells. In certain embodiments, the sample can be a neoplastic tissue sample or somatic tissue. Illustrative samples for use in the present methods include any type of solid tumor, in particular, a solid tumor from colorectal, hepatocellular, gallbladder, pancreatic, esophageal, lung, breast, prostate, head and neck, renal cell carcinoma, ovarian, endometrial, cervical, bladder and urothelial cancers. Any solid tumor in which tumor-infiltrating lymphocytes are to be assessed is contemplated for use in the present methods. Somatic tissues that are the target of an autoimmune reaction include, but are not limited to, joint tissues, skin, intestinal tissue, all layers of the uvea, iris, vitreous tissue, heart, brain, lungs, blood vessels, liver, kidney, nerve tissue, muscle, spinal cord, pancreas, adrenal gland, tendon, mucus membrane, lymph node, thyroid, endometrium, connective tissue, and bone marrow. In certain embodiments, DNA or RNA can be extracted from a transplanted organ, such as a transplanted liver, lung, kidney, heart, spleen, pancreas, skin, intestine, and thymus.

In other embodiments, two or more samples can be obtained from a single tissue (e.g., a single neoplastic tissue) and the relative representations of adaptive immune cells in the two or more samples are quantified to consider variations in different sections of a test tissue. In certain other embodiments, the determination of the relative representation of adaptive immune cells in one sample from a test tissue is sufficient due to minimum variations among different sections of the test tissue.

Compositions (Primers for Multiplex PCR)

Compositions are provided for use in a multiplex PCR that comprise a plurality of V-segment primers and a plurality of J-segment primers that are capable of promoting amplification of substantially all productively rearranged adaptive immune receptor CDR3-encoding regions in a sample to produce a multiplicity of amplified rearranged DNA molecules from a population of T cells (for TCR) or B cells (for Ig) in the sample.

The TCR and Ig genes can generate millions of distinct proteins via somatic mutation. Because of this diversity-generating mechanism, the hypervariable complementarity determining regions of these genes can encode sequences that can interact with millions of ligands, and these regions are linked to a constant region that can transmit a signal to the cell indicating binding of the protein's cognate ligand. The adaptive immune system employs several strategies to generate a repertoire of T- and B-cell antigen receptors with sufficient diversity to recognize the universe of potential pathogens. In αβ and γδ T cells, which primarily recognize peptide antigens presented by MHC molecules, most of this receptor diversity is contained within the third complementarity-determining region (CDR3) of the T cell receptor (TCR) α and β chains (or γ and δ chains).

In the human genome, there are currently believed to be about 70 TCR Vα and about 61 Jα gene segments, about 52 TCR Vβ, about 2 DP and about 13 Jβ gene segments, about 9 TCR Vγ and about 5 Jγ gene segments, and about 46 immunoglobulin heavy chain (IGH) $V_H$, about 23 $D_H$ and about 6 $J_H$ gene segments. Accordingly, where genomic sequences for these loci are known such that specific molecular probes for each of them can be readily produced, it is believed, according to non-limiting theory, that the present compositions and methods relate to substantially all (e.g., greater than 90%, 91%, 92%, 93%, 94%, 95%, 96%, 97%, 98% or 99%) of these known and readily detectable adaptive immune receptor V-, D- and J-region encoding gene segments.

In one embodiment, the compositions of the invention provide a plurality of V-segment primers and a plurality of J-segment primers that are capable of amplifying substantially all combinations of the V and J segments of a rearranged immune receptor locus. The term "substantially all combinations" refers to at least 90%, 91%, 92%, 93%, 94%, 95%, 96%, 97%, 98%, 99% or more of all the combinations of the V- and J-segments of a rearranged immune receptor locus. In certain embodiments, the plurality of V-segment primers and the plurality of J-segment primers amplify all of the combinations of the V and J segments of a rearranged immune receptor locus. In certain embodiments, the plurality of V-segment and J-segment primers can each comprise or consist of a nucleic acid sequence that is the same as, complementary to, or substantially complementary to a contiguous sequence of a target V- or J-region encoding segment (i.e., portion of genomic polynucleotide encoding a V-region or J-region polypeptide, or a portion of mRNA).

In some embodiments, the V-segment and J-segment primers are "fully complementary" to a contiguous sequence of a target V- or J-region encoding segment, respectively. In other embodiments, the V-segment and J-segment primers are "substantially complementary" with respect to contiguous sequence of a target V- or J-region encoding segment. Generally there are no more than 4, 3 or 2 mismatched base pairs upon hybridization, while retaining the ability to hybridize under the conditions most relevant to their ultimate application.

In certain embodiments, two pools of primers are designed for use in a highly multiplexed PCR reaction. The first "forward" pool can include oligonucleotide primers that are each specific to (e.g., having a nucleotide sequence complementary to a unique sequence region of) each V-region encoding segment ("V segment") in the respective TCR or Ig gene locus. In certain embodiments, primers targeting a highly conserved region are used, to simultaneously capture many V segments, thereby reducing the number of primers required in the multiplex PCR. In this manner, a V-segment primer can be complementary to (e.g., hybridize to) more than one functional TCR or Ig V-region encoding segment and act as a promiscuous primer. In other embodiments, each V-segment primer is specific for a different, functional TCR or Ig V-region encoding segment.

The "reverse" pool primers can include oligonucleotide primers that are each specific to (e.g., having a nucleotide sequence complementary to a unique sequence region of) each J-region encoding segment ("J segment") in the respective TCR or Ig gene locus. In some embodiments, the J-primer can anneal to a conserved sequence in the joining ("J") segment. In certain embodiments, a J-segment primer can be complementary to (e.g., hybridize to) more than one J-segment. In other embodiments, each J-segment primer is specific to a different, functional TCR or Ig J-region encoding segment. By way of illustration and not limitation, V-segment primers can be used as "forward" primers and J-segment primers can be used as "reverse" primers, according to commonly used PCR terminology, but the skilled person will appreciate that in certain other embodiments J-segment primers may be regarded as "forward" primers when used with V-segment "reverse" primers.

In some embodiments, the V-segment or J-segment primer is at least 15 nucleotides in length. In other embodiments, the V-segment or J-segment primer is at least 16, 17, 18, 19, 20, 21, 22, 23, 24, 25, 26, 27, 28, 29, 30, 31, 32, 33, 34, 35, 36, 37, 38, 39, 40, 45, or 50 nucleotides in length and has the same sequence as, or is complementary to, a contiguous sequence of the target V- or J-region encoding segment. In some embodiments, the length of the primers may be longer, such as about 55, 56, 57, 58, 59, 60, 61, 62, 63, 64, 65, 66, 67, 68, 69, 70, 71, 72, 73, 74, 75, 80, 85, 90, 95, 100 or more nucleotides in length or more, depending on the specific use or need. All intermediate lengths of the presently described primers are contemplated for use herein. As would be recognized by the skilled person, the primers can comprise additional sequences (e.g., nucleotides that may not be the same as or complementary to the target V- or J-region encoding polynucleotide segment), such as restriction enzyme recognition sites, universal adaptor sequences for sequencing, bar code sequences, chemical modifications, and the like (see e.g., primer sequences provided in the sequence listing herein).

In other embodiments, the V-segment or J-segment primers comprise sequences that share a high degree of sequence identity to the oligonucleotide primers for which nucleotide sequences are presented herein, including those set forth in the Sequence Listing. In certain embodiments, the V-segment or J-segment primers comprise primer variants that may have substantial identity to the adaptive immune receptor V-segment or J-segment primer sequences disclosed herein. For example, such oligonucleotide primer variants may comprise at least 70% sequence identity, preferably at least 75%, 80%, 85%, 90%, 91%, 92%, 93%, 94%, 95%, 96%, 97%, 98%, or 99% or higher sequence identity compared to a reference oligonucleotide sequence, such as the oligonucleotide primer sequences disclosed herein, using the methods described herein (e.g., BLAST analysis using standard parameters). One skilled in this art will recognize that these values can be appropriately adjusted to determine corresponding ability of an oligonucleotide primer variant to anneal to an adaptive immune receptor segment-encoding polynucleotide by taking into account codon degeneracy, reading frame positioning and the like. Typically, oligonucleotide primer variants will contain one or more substitutions, additions, deletions and/or insertions, preferably such that the annealing ability of the variant oligonucleotide is not substantially diminished relative to that of an adaptive immune receptor V-segment or J-segment primer sequence that is specifically set forth herein. In other embodiments, the V-segment or J-segment primers are designed to be capable of amplifying a rearranged TCR or IGH sequence that includes the coding region for CDR3.

In some embodiments, as described herein, the plurality of V-segment and J-segment primers each comprise additional sequences at the 5' end, such as universal adaptor sequences, bar code sequences, random oligonucleotide sequences, and the like. The sequences can be non-naturally occurring sequences and/or sequences that do not naturally appear adjacent to contiguous with a target V- or J-region encoding segment.

In certain embodiments, the plurality of V-segment and J-segment primers are designed to produce amplified rearranged DNA molecules that are less than 600 nucleotides in length, thereby excluding amplification products from non-rearranged adaptive immune receptor loci. In some embodiments, the amplified rearranged DNA molecules are at least 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, or 600 nucleotides in length. In one embodiment, the amplified rearranged DNA molecule is at least 250 nucleotides in length. In another embodiment, the amplified rearranged DNA molecule is approximately 200 nucleotides in length. The amplified rearranged DNA molecule can be referred to as an amplicon, amplified molecule, PCR product, or amplification product, for example.

An exemplary multiplex PCR assay uses a plurality of forward V-segment primers and a plurality of reverse J-segment primers to selectively amplify the rearranged VDJ from each cell. While these primers can anneal to both rearranged and germline V and J gene segments, PCR amplification is limited to rearranged gene segments, due to size bias (e.g., 250 bp PCR product using rearranged gene segments as templates vs. >10 Kb PCR product using germline gene segments as templates).

In some embodiments, primer selection and primer set design can be performed in a manner that preferably detects productive V and J gene segments, and excludes TCR or IG pseudogenes. Pseudogenes may include V segments that contain an in-frame stop codon within the V-segment coding sequence, a frameshift between the start codon and the CDR3 encoding sequence, one or more repeat-element insertions, and deletions of critical regions, such as the first exon or the RSS. In the human IGH locus, for instance, the ImmunoGeneTics (IMGT) database (M.-P. LeFranc, Université Montpellier, Montpellier, France; www.imgt.org) annotates 165 V segment genes, of which 26 are orphons on other chromosomes and 139 are in the IGH locus at chromosome 14. Among the 139 V segments within the IGH locus, 51 have at least one functional allele, while 6 are ORFs (open-reading frames) which are missing at least one highly conserved amino-acid residue, and 81 are pseudogenes.

To detect functional TCR or IG rearrangements in a sample while avoiding potentially extraneous amplification signals that may be attributable to non-productive V and/or J gene segments such as pseudogenes and/or orphons, it is therefore contemplated according to certain embodiments to use a subset of oligonucleotide primers which are designed to include only those V segments that participate in a functional rearrangement to encode a TCR or IG, without having to include amplification primers specific to the pseudogene and/or orphon sequences or the like. Advantageous efficiencies with respect, inter alia, to time and expense are thus obtained.

The plurality of V-segment primers and J-segment primers are designed to sit outside regions where untemplated deletions occur. These V-segment primer and J-segment primer positions are relative to the V gene recombination signal sequence (V-RSS) and J gene recombination signal sequence (J-RSS) in the gene segment. In some embodiments, the V-segment primers and J-segment primers are designed to provide adequate sequence information in the amplified product to identify both the V and J genes uniquely.

In some embodiments, each of the V-segment primers comprises a first sequence and a second sequence, wherein the first sequence is located 3' to the second sequence on the V-segment primer. In certain embodiments, the first sequence is complementary to a portion of a first region of at least one V-segment, and the first region of the V-segment is located immediately 5' to a second region of the V-segment where untemplated deletions occur during TCR or IG gene rearrangement. The second region of the V-segment is adjacent to and 5' to a V-recombination signal sequence (V-RSS) of the V-segment. The second region where untemplated deletions occur on the V-segment can be at least 10 base pairs (bps) in length. In one embodiment, the 3'-end of the V-segment primer can be placed at least 10 bps upstream from the V-RSS. In some embodiments, the V-segment primer is placed greater than 40 base pairs of sequence upstream of the V-RSS.

In other embodiments, each of the J-segment primers has a first sequence and a second sequence, wherein the first sequence is located 3' to the second sequence on the J-segment primer. The first sequence of the J-segment primer is complementary to a portion of a first region of a J-segment, and the first region of the J-segment is located immediately 3' to a second region of the J-segment where untemplated deletions occur during TCR or IG gene rearrangement. The second region of the J-segment is adjacent to and 3' to a J-recombination signal sequence (J-RSS) of said J-segment, and the second region of the J-segment can be at least 10 base pairs in length. In some embodiments, the 3' end of the J-segment primers are placed at least 10 base pairs downstream of the J-RSS. In certain embodiments, as in TCR Jβ gene segments, the first region of the J-segment includes a unique four base tag at positions +11 through +14 downstream of the RSS site. In other embodiments, the J-segment deletions are 4 bp+/−2.5 bp in length, and the J-segment primers are placed at least 4 bp downstream of the J-RSS. In some embodiments, the J-segment primer is placed greater than 30 base pairs downstream of the J-RSS.

Further description about the design, placement and positioning of the V-segment primers and J-segment primers, and exemplary primers can be found in U.S. Ser. No. 12/794,507, filed on Jun. 4, 2010, International App. No. PCT/US2010/037477, filed on Jun. 4, 2010, and U.S. Ser. No. 13/217,126, filed on Aug. 24, 2011, and Robins et al., 2009 *Blood* 114, 4099, which are each incorporated by reference in its entirety.

Multiplex PCR Amplification

A multiplex PCR system can be used to amplify rearranged adaptive immune cell receptor loci from genomic DNA and from synthetic template oligonucleotides, preferably from a CDR3 region. In certain embodiments, the CDR3 region is amplified from a TCRα, TCRβ, TCRγ, or TCRδ CDR3 region, or similarly from an Ig locus, such as a IgH or IgL (lambda or kappa) locus.

In general, a multiplex PCR system comprises a plurality of V-segment forward primers and a plurality of J-segment reverse primers. The plurality of V-segment forward primers can comprise at least 2, 3, 4, 5, 6, 7, 8, 9, 10, 11, 12, 13, 14, 15, 16, 17, 18, 19, 20, 21, 22, 23, 24, or 25, and in certain embodiments, at least 26, 27, 28, 29, 30, 31, 32, 33, 34, 35, 36, 37, 38, or 39, and in other embodiments 40, 41, 42, 43, 44, 45, 46, 47, 48, 49, 50, 51, 52, 53, 54, 55, 56, 57, 58, 59, 60, 65, 70, 75, 80, 85, or more forward primers. Each forward primer specifically hybridizes to or is complementary to a sequence corresponding to one or more V region segments.

For example, illustrative V-segment primers for amplification of the TCRB are shown in SEQ ID NOs: 1-120. Illustrative J-segment primers for TCRB are shown in SEQ ID NOs: 121-146. Illustrative TCRG V-segment primers are provided in SEQ ID NOs: 147-158. Illustrative TCRG J-segment primers are provided in SEQ ID NOs: 159-166. Illustrative TCRA and TCRD V-segment primers are found in SEQ ID NOs: 167-276. Exemplary TCRA and TCRD J-segment primers are found in SEQ ID NOs: 277-406. Illustrative IGH V-segment primers are provided in SEQ ID NOs 407-578. Exemplary IGH J-segment primers are found in SEQ ID NOs: 579-592. Exemplary IGK and IGL V-segment primers are found in SEQ ID NOs: 593-740. Exemplary IGK and IGL J-segment primers are found in SEQ ID NOs: 741-764.

The multiplex PCR system can use at least 3, 4, 5, 6, or 7, 8, 9, 10, 11, 12 or 13 reverse primers. In some embodiments, each reverse primer specifically hybridizes to or is complementary to a sequence corresponding to one or more J region segments. In one embodiment, there is a different J segment primer for each J segment. No one J-segment primer is a universal primer that binds to all J-region segments.

Oligonucleotides that are capable of specifically hybridizing or annealing to a target nucleic acid sequence by nucleotide base complementarity may do so under moderate to high stringency conditions. For purposes of illustration, suitable moderate to high stringency conditions for specific PCR amplification of a target nucleic acid sequence would be between 25 and 80 PCR cycles, with each cycle consisting of a denaturation step (e.g., about 10-30 seconds (s) at least about 95° C.), an annealing step (e.g., about 10-30 s at about 60-68° C.), and an extension step (e.g., about 10-60 s at about 60-72° C.), optionally according to certain embodiments with the annealing and extension steps being combined to provide a two-step PCR. As would be recognized by the skilled person, other PCR reagents may be added or changed in the PCR reaction to increase specificity of primer annealing and amplification, such as altering the magnesium concentration, optionally adding DMSO, and/or the use of blocked primers, modified nucleotides, peptide-nucleic acids, and the like.

In certain embodiments, nucleic acid hybridization techniques may be used to assess hybridization specificity of the primers described herein. Hybridization techniques are well known in the art of molecular biology. For purposes of illustration, suitable moderately stringent conditions for testing the hybridization of a polynucleotide as provided herein with other polynucleotides include prewashing in a solution of 5×SSC, 0.5% SDS, 1.0 mM EDTA (pH 8.0); hybridizing at 50° C.-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60° C.-65° C. or 65° C.-70° C.

In certain embodiments, the primers are designed not to cross an intron/exon boundary. The forward primers in certain embodiments anneal to the V segments in a region of relatively strong sequence conservation between V segments so as to maximize the conservation of sequence among these primers. Accordingly, this minimizes the potential for differential annealing properties of each primer, and so that the amplified region between V- and J-segment primers contains sufficient TCR or Ig V sequence information to identify the specific V gene segment used. In one embodiment, the J-segment primers hybridize with a conserved element of the J segment, and have similar annealing strength. In one particular embodiment, the J segment primers anneal to the same conserved framework region motif.

Oligonucleotides (e.g., primers) can be prepared by any suitable method, including direct chemical synthesis by a method such as the phosphotriester method of Narang et al., 1979, Meth. Enzymol. 68:90-99; the phosphodiester method of Brown et al., 1979, Meth. Enzymol. 68:109-151; the diethylphosphoramidite method of Beaucage et al., 1981, Tetrahedron Lett. 22:1859-1862; and the solid support method of U.S. Pat. No. 4,458,066, each incorporated herein by reference. A review of synthesis methods of conjugates of oligonucleotides and modified nucleotides is provided in Goodchild, 1990, Bioconjugate Chemistry 1(3): 165-187, incorporated herein by reference.

High Throughput Sequencing

Sequencing Oligonucleotides

In one embodiment, the V-segment primers and J-segment primers of the invention include a second subsequence situated at their 5' ends that include a universal adaptor sequence complementary to and that can hybridize to sequencing adaptor sequences for use in a DNA sequencer, such as Illumina.

In certain embodiments, the J-region encoding gene segments each have a unique sequence-defined identifier tag of 2, 3, 4, 5, 6, 7, 8, 9, 10 or about 15, 20 or more nucleotides, situated at a defined position relative to a RSS site. For example, a four-base tag may be used, in the Jβ-region encoding segment of amplified TCRβ CDR3-encoding regions, at positions +11 through +14 downstream from the RSS site. However, these and related embodiments need not be so limited and also contemplate other relatively short nucleotide sequence-defined identifier tags that may be detected in J-region encoding gene segments and defined based on their positions relative to an RSS site. These may vary between different adaptive immune receptor encoding loci.

The recombination signal sequence (RSS) consists of two conserved sequences (heptamer, 5'-CACAGTG-3', and nonamer, 5'-ACAAAAACC-3'), separated by a spacer of either 12+/-1 bp ("12-signal") or 23+/-1 bp ("23-signal"). A number of nucleotide positions have been identified as important for recombination including the CA dinucleotide at position one and two of the heptamer, and a C at heptamer position three has also been shown to be strongly preferred as well as an A nucleotide at positions 5, 6, 7 of the nonamer. (Ramsden et. al 1994; Akamatsu et. al. 1994; Hesse et. al. 1989). Mutations of other nucleotides have minimal or inconsistent effects. The spacer, although more variable, also has an impact on recombination, and single-nucleotide replacements have been shown to significantly impact recombination efficiency (Fanning et. al. 1996, Larijani et. al 1999; Nadel et. al. 1998). Criteria have been described for identifying RSS polynucleotide sequences having significantly different recombination efficiencies (Ramsden et. al 1994; Akamatsu et. al. 1994; Hesse et. al. 1989 and Cowell et. al. 1994). Accordingly, the sequencing oligonucleotides may hybridize adjacent to a four base tag within the amplified J-encoding gene segments at positions +11 through +14 downstream of the RSS site. For example, sequencing oligonucleotides for TCRB may be designed to anneal to a consensus nucleotide motif observed just downstream of this "tag", so that the first four bases of a sequence read will uniquely identify the J-encoding gene segment. Exemplary sequencing oligonucleotide sequences are found, for example in SEQ ID NOs: 765-786.

The information used to assign identities to the J- and V-encoding segments of a sequence read is entirely contained within the amplified sequence, and does not rely upon the identity of the PCR primers. In particular, the methods described herein allow for the amplification of all possible V-J combinations at a TCR or Ig locus and sequencing of the individual amplified molecules allows for the identification and quantitation of the rearranged DNA encoding the CDR3 regions. The diversity of the adaptive immune cells of a given sample can be inferred from the sequences generated using the methods and algorithms described herein.

High Throughput Sequencing Methods

Methods of the invention further comprise sequencing the amplified adaptive immune receptor encoding DNA molecules that are produced. Sequencing can performed on amplicon products produced from a biological sample comprising adaptive immune cells, and/or of the synthetic template oligonucleotides that are described below.

In one embodiment, sequencing involves using a set of sequencing oligonucleotides (adaptor sequences) that hybridize to sequencing oligonucleotide sequences within the amplified DNA molecules or the synthetic template oligonucleotides that are described below.

Sequencing may be performed using any of a variety of available high through-put single molecule sequencing machines and systems. Illustrative sequence systems include sequence-by-synthesis systems such as the Illumina Genome Analyzer, the Illumina MiSeq, and associated instruments (Illumina, Inc., San Diego, Calif.), Helicos Genetic Analysis System (Helicos BioSciences Corp., Cambridge, Mass.), Pacific Biosciences PacBio RS (Pacific Biosciences, Menlo Park, Calif.), or other systems having similar capabilities. Sequencing is achieved using a set of sequencing oligonucleotides that hybridize to a defined region within the amplified DNA molecules. The sequencing oligonucleotides are designed such that the V- and J-encoding gene segments can be uniquely identified by the sequences that are generated, based on the present disclosure and in view of known adaptive immune receptor gene sequences that appear in publicly available databases.

In certain embodiments, at least 30, 40, 50, 60, 70, 80, 90, 100, 101-150, 151-200, 201-300, 301-500, and not more than 1000 contiguous nucleotides of the amplified adaptive immune receptor encoding DNA molecules are sequenced. In some embodiments, the amplicons and synthetic template oligonucleotides that are sequenced are less than 600 bps in length. In further embodiments, the resulting sequencing reads are approximately 130 bps in length. In yet further embodiments, approximately 30 million sequencing reads are produced per sequencing assay.

Compositions and methods for the sequencing of rearranged adaptive immune receptor gene sequences and for adaptive immune receptor clonotype determination are described further in Robins et al., 2009 *Blood* 114, 4099; Robins et al., 2010 *Sci. Translat. Med.* 2:47ra64; Robins et al., 2011 *J. Immunol. Meth.* doi:10.1016/j.jim.2011.09.001; Sherwood et al. 2011 *Sci. Translat. Med.* 3:90ra61; U.S. Ser. No. 13/217,126 (US Pub. No. 2012/0058902), U.S. Ser. No. 12/794,507 (US Pub. No. 2010/0330571), WO/2010/151416, WO/2011/106738 (PCT/US2011/026373), WO2012/027503 (PCT/US2011/049012), U.S. Ser. No. 61/550,311, and U.S. Ser. No. 61/569,118, which are incorporated by reference their entireties.

In certain embodiments, the amplified J-region encoding gene segments may each have a unique sequence-defined identifier tag of 2, 3, 4, 5, 6, 7, 8, 9, 10 or about 15, 20 or more nucleotides, situated at a defined position relative to a RSS site. For example, a four-base tag may be used, in the Jβ-region encoding segment of amplified TCRβ CDR3-encoding regions, at positions +11 through +14 downstream from the RSS site. However, these and related embodiments need not be so limited and also contemplate other relatively short nucleotide sequence-defined identifier tags that may be detected in J-region encoding gene segments and defined based on their positions relative to an RSS site. These may vary between different adaptive immune receptor encoding loci.

The recombination signal sequence (RSS) consists of two conserved sequences (heptamer, 5'-CACAGTG-3', and nonamer, 5'-ACAAAAACC-3'), separated by a spacer of either 12+/−1 bp ("12-signal") or 23+/−1 bp ("23-signal"). A number of nucleotide positions have been identified as important for recombination including the CA dinucleotide at position one and two of the heptamer, and a C at heptamer position three has also been shown to be strongly preferred as well as an A nucleotide at positions 5, 6, 7 of the nonamer. (Ramsden et. al 1994; Akamatsu et. al. 1994; Hesse et. al. 1989). Mutations of other nucleotides have minimal or inconsistent effects. The spacer, although more variable, also has an impact on recombination, and single-nucleotide replacements have been shown to significantly impact recombination efficiency (Fanning et. al. 1996, Larijani et. al 1999; Nadel et. al. 1998). Criteria have been described for identifying RSS polynucleotide sequences having significantly different recombination efficiencies (Ramsden et. al 1994; Akamatsu et. al. 1994; Hesse et. al. 1989 and Cowell et. al. 1994). Accordingly, the sequencing oligonucleotides may hybridize adjacent to a four base tag within the amplified J-encoding gene segments at positions +11 through +14 downstream of the RSS site. For example, sequencing oligonucleotides for TCRB may be designed to anneal to a consensus nucleotide motif observed just downstream of this "tag", so that the first four bases of a sequence read will uniquely identify the J-encoding gene segment. Exemplary TCRB J primers are found in SEQ ID NOs:121-146 (TCRB J-segment reverse primers (gene specific) and TCRB J-segment reverse primers with an universal adaptor sequence.

The information used to assign identities to the J- and V-encoding segments of a sequence read is entirely contained within the amplified sequence, and does not rely upon the identity of the PCR primers. In particular, the methods described herein allow for the amplification of all possible V-J combinations at a TCR or Ig locus and sequencing of the individual amplified molecules allows for the identification and quantitation of the rearranged DNA encoding the CDR3 regions. The diversity of the adaptive immune cells of a given sample can be inferred from the sequences generated using the methods and algorithms described herein. One surprising advantage provided in certain preferred embodiments by the compositions and methods of the present disclosure was the ability to amplify successfully all possible V-J combinations of an adaptive immune cell receptor locus in a single multiplex PCR reaction.

In certain embodiments, the sequencing oligonucleotides described herein may be selected such that promiscuous priming of a sequencing reaction for one J-encoding gene segment by an oligonucleotide specific to another distinct J-encoding gene segment generates sequence data starting at exactly the same nucleotide as sequence data from the correct sequencing oligonucleotide. In this way, promiscuous annealing of the sequencing oligonucleotides does not impact the quality of the sequence data generated.

The average length of the CDR3-encoding region, for the TCR, defined as the nucleotides encoding the TCR polypeptide between the second conserved cysteine of the V segment and the conserved phenylalanine of the J segment, is 35+/−3 nucleotides. Accordingly and in certain embodiments, PCR amplification using V-segment primers and J-segment primers that start from the J segment tag of a particular TCR or IgH J region (e.g., TCR Jβ, TCR Jγ or IgH JH as described herein) will nearly always capture the complete V-D-J junction in a 50 base pair read. The average length of the IgH CDR3 region, defined as the nucleotides between the conserved cysteine in the V segment and the conserved phenylalanine in the J segment, is less constrained than at the TCRI3 locus, but will typically be between about 10 and about 70 nucleotides. Accordingly and in certain embodiments, PCR amplification using V-segment primers and J-segment primers that start from the IgH J segment tag will capture the complete V-D-J junction in a 100 base pair read.

PCR primers that anneal to and support polynucleotide extension on mismatched template sequences are referred to as promiscuous primers. In certain embodiments, the TCR and Ig J-segment reverse PCR primers may be designed to minimize overlap with the sequencing oligonucleotides, in order to minimize promiscuous priming in the context of multiplex PCR. In one embodiment, the TCR and Ig J-segment reverse primers may be anchored at the 3' end by annealing to the consensus splice site motif, with minimal overlap of the sequencing primers. Generally, the TCR and Ig V and J-segment primers may be selected to operate in PCR at consistent annealing temperatures using known sequence/primer design and analysis programs under default parameters. For the sequencing reaction, exemplary IGH J primers used for sequencing are found in SEQ ID NOs: 579-592 (showing IGH J-segment reverse primers (gene specific) and IGH J-segment reverse primers with a universal adaptor sequence.

Processing Sequence Data

As presently disclosed, there are also provided methods for analyzing the sequences of the diverse pool of rearranged CDR3-encoding regions that are generated using the compositions and methods that are described herein. In particular, an algorithm is provided to correct for PCR bias, sequencing and PCR errors and for estimating true distribution of specific clonotypes (e.g., a TCR or Ig having a uniquely rearranged CDR3 sequence) in a sample. A preferred algorithm is described in further detail herein. As would be recognized by the skilled person, the algorithms provided herein may be modified appropriately to accommodate particular experimental or clinical situations.

The use of a PCR step to amplify the TCR or Ig CDR3 regions prior to sequencing could potentially introduce a systematic bias in the inferred relative abundance of the sequences, due to differences in the efficiency of PCR amplification of CDR3 regions utilizing different V and J gene segments. As discussed in more detail in the Examples, each cycle of PCR amplification potentially introduces a bias of average magnitude $1.5^{1/15}=1.027$. Thus, the 25 cycles of PCR introduces a total bias of average magnitude $1.027^{25}=1.95$ in the inferred relative abundance of distinct CDR3 region sequences.

Sequenced reads are filtered for those including CDR3 sequences. Sequencer data processing involves a series of steps to remove errors in the primary sequence of each read, and to compress the data. A complexity filter removes approximately 20% of the sequences that are misreads from the sequencer. Then, sequences were required to have a minimum of a six base match to both one of the TCR or Ig J-regions and one of V-regions. Applying the filter to the control lane containing phage sequence, on average only one sequence in 7-8 million passed these steps. Finally, a nearest neighbor algorithm is used to collapse the data into unique sequences by merging closely related sequences, in order to remove both PCR error and sequencing error.

Analyzing the data, the ratio of sequences in the PCR product are derived working backward from the sequence data before estimating the true distribution of clonotypes (e.g., unique clonal sequences) in the blood. For each sequence observed a given number of times in the data herein, the probability that that sequence was sampled from a particular size PCR pool is estimated. Because the CDR3 regions sequenced are sampled randomly from a massive pool of PCR products, the number of observations for each sequence are drawn from Poisson distributions. The Poisson parameters are quantized according to the number of T cell genomes that provided the template for PCR. A simple Poisson mixture model both estimates these parameters and places a pairwise probability for each sequence being drawn from each distribution. This is an expectation maximization method which reconstructs the abundances of each sequence that was drawn from the blood.

To estimate the total number of unique adaptive immune receptor CDR3 sequences that are present in a sample, a computational approach employing the "unseen species" formula may be employed (Efron and Thisted, 1976 *Biometrika* 63, 435-447). This approach estimates the number of unique species (e.g., unique adaptive immune receptor sequences) in a large, complex population (e.g., a population of adaptive immune cells such as T cells or B cells), based on the number of unique species observed in a random, finite sample from a population (Fisher et al., 1943 *J. Anim. Ecol.* 12:42-58; Ionita-Laza et al., 2009 *Proc. Nat. Acad. Sci. USA* 106:5008). The method employs an expression that predicts the number of "new" species that would be observed if a second random, finite and identically sized sample from the same population were to be analyzed. "Unseen" species refers to the number of new adaptive immune receptor sequences that would be detected if the steps of amplifying adaptive immune receptor-encoding sequences in a sample and determining the frequency of occurrence of each unique sequence in the sample were repeated an infinite number of times. By way of non-limiting theory, it is operationally assumed for purposes of these estimates that adaptive immune cells (e.g., T cells, B cells) circulate freely in the anatomical compartment of the subject that is the source of the sample from which diversity is being estimated (e.g., blood, lymph, etc.).

To apply this formula, unique adaptive immune receptors (e.g., TCRβ, TCRα, TCRγ, TCRδ, IgH) clonotypes takes the place of species. The mathematical solution provides that for S, the total number of adaptive immune receptors having unique sequences (e.g., TCRβ, TCRγ, IgH "species" or clonotypes, which may in certain embodiments be unique CDR3 sequences), a sequencing experiment observes $x_s$ copies of sequence s. For all of the unobserved clonotypes, $x_s$ equals 0, and each TCR or Ig clonotype is "captured" in the course of obtaining a random sample (e.g., a blood draw) according to a Poisson process with parameter $\lambda_s$. The number of T or B cell genomes sequenced in the first measurement is defined as 1, and the number of T or B cell genomes sequenced in the second measurement is defined as t.

Because there are a large number of unique sequences, an integral is used instead of a sum. If $G(\lambda)$ is the empirical distribution function of the parameters $\lambda_1, \ldots, \lambda_S$, and $n_x$ is the number of clonotypes (e.g., unique TCR or Ig sequences, or unique CDR3 sequences) observed exactly x times, then the total number of clonotypes, i.e., the measurement of diversity E, is given by the following formula (I):

$$E(n_x) = S \int_0^\infty \left(\frac{e^{-\lambda}\lambda^x}{x!}\right) dG(\lambda). \tag{I}$$

Accordingly, formula (I) may be used to estimate the total diversity of species in the entire source from which the identically sized samples are taken. Without wishing to be bound by theory, the principle is that the sampled number of clonotypes in a sample of any given size contains sufficient information to estimate the underlying distribution of clonotypes in the whole source. The value for $\Delta(t)$, the number of new clonotypes observed in a second measurement, may be determined, preferably using the following equation (II):

$$\Delta(t) = \sum_x E(n_x)_{msmt1+msmt2} - \sum_x E(n_x)_{msmt1} = S \int_0^\infty e^{-\lambda}(1-e^{-\lambda t})dG(\lambda) \tag{II}$$

in which msmt1 and msmt2 are the number of clonotypes from measurements 1 and 2, respectively. Taylor expansion of $1-e^{-\lambda t}$ and substitution into the expression for $\Delta(t)$ yields:

$$\Delta(t)=E(x_1)t-E(x_2)t^2+E(x_3)t^3-\ldots, \tag{III}$$

which can be approximated by replacing the expectations $(E(n_x))$ with the actual numbers sequences observed exactly x times in the first sample measurement. The expression for $\Delta(t)$ oscillates widely as t goes to infinity, so $\Delta(t)$ is regularized to produce a lower bound for $\Delta(\infty)$, for example, using the Euler transformation (Efron et al., 1976 *Biometrika* 63:435).

According to certain herein expressly disclosed embodiments, there are also presently provided methods in which the degree of clonality of adaptive immune cells that are present in a sample, such as a sample that comprises a mixture of cells only some of which are adaptive immune cells, can be determined advantageously without the need for cell sorting or for DNA sequencing. These and related embodiments overcome the challenges of efficiency, time and cost that, prior to the present disclosure, have hindered the ability to determine whether adaptive immune cell presence in a sample (e.g., TIL) is monoclonal or oligoclonal (e.g., whether all TILs are the progeny of one or a relatively limited number of adaptive immune cells), or whether instead adaptive immune cell presence in the sample is polyclonal (e.g., TILs are the progeny of a relatively large number of adaptive immune cells).

According to non-limiting theory, these embodiments exploit current understanding in the art (also described above) that once an adaptive immune cell (e.g., a T or B lymphocyte) has rearranged its adaptive immune receptor-encoding (e.g., TCR or Ig) genes, its progeny cells possess the same adaptive immune receptor-encoding gene rearrangement, thus giving rise to a clonal population that can be identified by the presence therein of rearranged CDR3-encoding V- and J-gene segments that may be amplified by a specific pairwise combination of V- and J-specific oligonucleotide primers as herein disclosed.

Synthetic Template Oligonucleotide Compositions for Use in Quantifying Input Genomes from Adaptive Immune Cells, and Determining Relative Representation of Adaptive Immune Cells Synthetic Template Compositions Useful for Quantifying Numbers of Input Molecules in a Sample Synthetic template oligonucleotides can be designed to quantify a number of input molecules in a biological sample.

As used herein "synthetic template" means an oligonucleotide containing sequences which include sequences substantially identical to biological sequences (i.e. TCR or IG V, J or C segments or genomic control regions) in addition to non-naturally occurring sequences (i.e. barcodes, randomers, adaptors, etc.). The full nucleotide sequence of synthetic templates, therefore, do not occur in nature and are, instead, laboratory designed and made sequences. A ratio of the number of input synthetic template oligonucleotide molecules in a sample compared to the number of total output sequencing reads of synthetic template oligonucleotides (sequenced from synthetic template amplicons) in the sample is determined. In one embodiment, a limiting dilution of synthetic template oligonucleotides (which allows for the determination of the number of total synthetic template oligonucleotide molecules present by measuring the number of unique synthetic template oligonucleotide sequences observed) is added to a biological sample for multiplex PCR, and by assuming the same ratio holds for biological as synthetic templates, the ratio is used to determine the number of rearranged T or B cell receptor molecules, and thus the number of T or B cells, in the biological sample.

The invention comprises a synthetic template composition comprising a plurality of template oligonucleotides of general formula (I):

$$5'\text{-}U1\text{-}B1\text{-}V\text{-}B2\text{-}J\text{-}B3\text{-}U2\text{-}3' \qquad (I).$$

The constituent template oligonucleotides are diverse with respect to the nucleotide sequences of the individual template oligonucleotides.

In one embodiment, U1 and U2 are each either nothing or each comprise an oligonucleotide having, independently, a sequence that is selected from (i) a universal adaptor oligonucleotide sequence, and (ii) a sequencing platform-specific oligonucleotide sequence that is linked to and positioned 5' to the universal adaptor oligonucleotide sequence.

B1, B2, and B3 can each be independently either nothing or each comprise an oligonucleotide "B" that comprises an oligonucleotide barcode sequence of 3, 4, 5, 6, 7, 8, 9, 10, 11, 12, 13, 14, 15, 16, 17, 18, 19, 20, 25, 30, 35, 40, 45, 50, 60, 70, 80, 90, 100, 200, 300, 400, 500, 600, 700, 800, 900 or 1000 contiguous nucleotides (including all integer values therebetween). In some embodiments, B1, B2, and B3 can each comprise a unique oligonucleotide sequence that uniquely identifies, or identifies as a paired combination, (i) the unique V oligonucleotide sequence of the template oligonucleotide and (ii) the unique J oligonucleotide sequence of the template oligonucleotide.

The relative positioning of the barcode oligonucleotides B1, B2, and B3 and universal adaptors U1 and U2 advantageously permits rapid identification and quantification of the amplification products of a given unique template oligonucleotide by short sequence reads and paired-end sequencing on automated DNA sequencers (e.g., Illumina HiSeq™ or Illumina MiSEQ®, or GeneAnalyzer™-2, Illumina Corp., San Diego, Calif.). In particular, these and related embodiments permit rapid high-throughput determination of specific combinations of a V-segment sequence and a J-segment sequence that are present in an amplification product, thereby to characterize the relative amplification efficiency of each V-specific primer and each J-specific primer that may be present in a primer set, which is capable of amplifying rearranged TCR or BCR encoding DNA in a sample. Verification of the identities and/or quantities of the amplification products may be accomplished by longer sequence reads, optionally including sequence reads that extend to B2.

V can be either nothing or a polynucleotide comprising at least 20, 30, 60, 90, 120, 150, 180, or 210, and not more than 1000, 900, 800, 700, 600 or 500 contiguous nucleotides of a DNA sequence. In some embodiments, the DNA sequence is of an adaptive immune receptor variable (V) region encoding gene sequence, or the complement thereof, and in each of the plurality of template oligonucleotide sequences V comprises a unique oligonucleotide sequence.

J can be either nothing or a polynucleotide comprising at least 15-30, 31-60, 61-90, 91-120, or 120-150, and not more than 600, 500, 400, 300 or 200 contiguous nucleotides of a DNA sequence. In some embodiments, the DNA sequence is of an adaptive immune receptor joining (J) region encoding gene sequence, or the complement thereof, and in each of the plurality of template oligonucleotide sequences J comprises a unique oligonucleotide sequence.

In constructing the "V" and "J" portions of the synthetic template oligonucleotides of formula I, various adaptive immune receptor variable (V) region and joining (J) region gene sequences can be used. A large number of V and J region gene sequences are known as nucleotide and/or amino acid sequences, including non-rearranged genomic DNA sequences of TCR and Ig loci, and productively rearranged DNA sequences at such loci and their encoded products, and also including pseudogenes at these loci, and also including related orphons. See, e.g., U.S. Ser. No. 13/217,126; U.S. Ser. No. 12/794,507; PCT/US2011/026373; PCT/US2011/049012, which are incorporated by reference in their entireties. Moreover, genomic sequences for TCR and BCR V region genes of humans and other species are known and available from public databases such as Genbank. V region gene sequences include polynucleotide sequences that encode the products of expressed, rearranged TCR and BCR genes and also include polynucleotide sequences of pseudogenes that have been identified in the V region loci. The diverse V polynucleotide sequences that may be incorporated into the presently disclosed templates of general formula (I) may vary widely in length, in nucleotide composition (e.g., GC content), and in actual linear polynucleotide sequence, and are known, for example, to include "hot spots" or hypervariable regions that exhibit particular sequence diversity. These and other sequences known to the art may be used according to the present disclosure for the design and production of template oligonucleotides to be included in the presently provided template composition for standardizing amplification efficiency of an oligonucleotide primer set, and for the design and production of the oligonucleotide primer set that is capable of amplifying rearranged DNA encoding TCR or Ig polypeptide chains, which rearranged DNA may be present in a biological sample comprising lymphoid cell DNA.

The entire polynucleotide sequence of each polynucleotide V in general formula (I) can, but need not, consist exclusively of contiguous nucleotides from each distinct V gene. For example and according to certain embodiments, in the template composition described herein, each polynucleotide V of formula (I) need only have at least a region comprising a unique V oligonucleotide sequence that is found in one V gene and to which a single V region primer in the primer set can specifically anneal. Thus, the V polynucleotide of formula (I) may comprise all or any prescribed portion (e.g., at least 15, 20, 30, 60, 90, 120, 150, 180 or 210 contiguous nucleotides, or any integer value therebetween) of a naturally occurring V gene sequence (including a V pseudogene sequence), so long as at least one unique V oligonucleotide sequence region (e.g., the primer annealing site) is included that is not included in any other template V polynucleotide.

In some embodiments, the plurality of V polynucleotides that are present in the synthetic template composition have lengths that simulate the overall lengths of known, naturally occurring V gene nucleotide sequences, even where the specific nucleotide sequences differ between the template V region and any naturally occurring V gene. The V region lengths in the synthetic templates can differ from the lengths of naturally occurring V gene sequences by no more than 1, 2, 3, 4, 5, 6, 7, 8, 9, 10, 11, 12, 13, 14, 15, 16, 17, 18, 19 or 20 percent. Optionally and according to certain embodiments, the V polynucleotide of the herein described synthetic template oligonucleotide includes a stop codon at or near the 3' end of V in general formula (I).

The V polynucleotide in formula (I) may thus, in certain embodiments, comprise a nucleotide sequence having a length that is the same or similar to that of the length of a typical V gene from its start codon to its CDR3 encoding region and may, but need not, include a nucleotide sequence that encodes the CDR3 region. CDR3 encoding nucleotide sequences and sequence lengths may vary considerably and have been characterized by several different numbering schemes (e.g., Lefranc, 1999 *The Immunologist* 7:132; Kabat et al., 1991 *In: Sequences of Proteins of Immunological Interest*, NIH Publication 91-3242; Chothia et al., 1987 *J. Mol. Biol.* 196:901; Chothia et al., 1989 *Nature* 342:877; Al-Lazikani et al., 1997 *J. Mol. Biol.* 273:927; see also, e.g., Rock et al., 1994 *J. Exp. Med.* 179:323; Saada et al., 2007 *Immunol. Cell Biol.* 85:323).

Briefly, the CDR3 region typically spans the polypeptide portion extending from a highly conserved cysteine residue (encoded by the trinucleotide codon TGY; Y=T or C) in the V segment to a highly conserved phenylalanine residue (encoded by TTY) in the J segment of TCRs, or to a highly conserved tryptophan (encoded by TGG) in IGH. More than 90% of natural, productive rearrangements in the TCRB locus have a CDR3 encoding length by this criterion of between 24 and 54 nucleotides, corresponding to between 9 and 17 encoded amino acids. The CDR3 lengths of the presently disclosed synthetic template oligonucleotides should, for any given TCR or BCR locus, fall within the same range as 95% of naturally occurring rearrangements. Thus, for example, in a synthetic template composition described herein, the CDR3 encoding portion of the V polynucleotide cab has a length of from 24 to 54 nucleotides, including every integer therebetween. The numbering schemes for CDR3 encoding regions described above denote the positions of the conserved cysteine, phenylalanine and tryptophan codons, and these numbering schemes may also be applied to pseudogenes in which one or more codons encoding these conserved amino acids may have been replaced with a codon encoding a different amino acid. For pseudogenes which do not use these conserved amino acids, the CDR3 length may be defined relative to the corresponding position at which the conserved residue would have been observed absent the substitution, according to one of the established CDR3 sequence position numbering schemes referenced above.

The entire polynucleotide sequence of each polynucleotide J in general formula (I) may, but need not, consist exclusively of contiguous nucleotides from each distinct J gene. For example and according to certain embodiments, in the template composition described herein, each polynucleotide J of formula (I) need only have at least a region comprising a unique J oligonucleotide sequence that is found in one J gene and to which a single V region primer in the primer set can specifically anneal. Thus, the V polynucleotide of formula (I) may comprise all or any prescribed portion (e.g., at least 15, 20, 30, 60, 90, 120, 150, 180 or 210 contiguous nucleotides, or any integer value therebetween) of a naturally occurring V gene sequence (including a V pseudogene sequence) so long as at least one unique V oligonucleotide sequence region (the primer annealing site) is included that is not included in any other template J polynucleotide.

It may be preferred in certain embodiments that the plurality of J polynucleotides that are present in the herein described template composition have lengths that simulate the overall lengths of known, naturally occurring J gene nucleotide sequences, even where the specific nucleotide sequences differ between the template J region and any naturally occurring J gene. The J region lengths in the herein described templates may differ from the lengths of naturally occurring J gene sequences by no more than 1, 2, 3, 4, 5, 6, 7, 8, 9, 10, 11, 12, 13, 14, 15, 16, 17, 18, 19 or 20 percent.

The J polynucleotide in formula (I) may thus, in certain embodiments, comprise a nucleotide sequence having a length that is the same or similar to that of the length of a typical naturally occurring J gene and may, but need not, include a nucleotide sequence that encodes the CDR3 region, as discussed above.

Genomic sequences for TCR and BCR J region genes of humans and other species are known and available from public databases such as Genbank; J region gene sequences include polynucleotide sequences that encode the products of expressed and unexpressed rearranged TCR and BCR genes. The diverse J polynucleotide sequences that may be incorporated into the presently disclosed templates of general formula (I) may vary widely in length, in nucleotide composition (e.g., GC content), and in actual linear polynucleotide sequence.

Alternatives to the V and J sequences described herein, for use in construction of the herein described template oligonucleotides and/or V-segment and J-segment oligonucleotide primers, may be selected by a skilled person based on the present disclosure using knowledge in the art regarding published gene sequences for the V- and J-encoding regions of the genes for each TCR and Ig subunit. Reference Genbank entries for human adaptive immune receptor sequences include: TCRα: (TCRA/D): NC_000014.8 (chr14:22090057 . . . 23021075); TCRβ: (TCRB): NC_000007.13 (chr7:141998851 . . . 142510972); TCRγ: (TCRG): NC_000007.13 (chr7:38279625 . . . 38407656); immunoglobulin heavy chain, IgH (IGH): NC_000014.8 (chr14: 106032614 . . . 107288051); immunoglobulin light chain-kappa, IgLκ (IGK): NC_000002.11 (chr2: 89156874 . . . 90274235); and immunoglobulin light chain-lambda, IgLλ (IGL): NC_000022.10 (chr22: 22380474 . . . 23265085). Reference Genbank entries for mouse adaptive immune receptor loci sequences include: TCRβ: (TCRB): NC_000072.5 (chr6: 40841295 . . . 41508370), and immunoglobulin heavy chain, IgH (IGH): NC_000078.5 (chr12: 114496979 . . . 117248165).

Template and primer design analyses and target site selection considerations can be performed, for example, using the OLIGO primer analysis software and/or the BLASTN 2.0.5 algorithm software (Altschul et al., *Nucleic Acids Res.* 1997, 25(17):3389-402), or other similar programs available in the art.

Accordingly, based on the present disclosure and in view of these known adaptive immune receptor gene sequences and oligonucleotide design methodologies, for inclusion in the instant template oligonucleotides those skilled in the art can design a plurality of V region-specific and J region-specific polynucleotide sequences that each independently contain oligonucleotide sequences that are unique to a given V and J gene, respectively. Similarly, from the present disclosure and in view of known adaptive immune receptor sequences, those skilled in the art can also design a primer set comprising a plurality of V region-specific and J region-specific oligonucleotide primers that are each independently capable of annealing to a specific sequence that is unique to a given V and J gene, respectively, whereby the plurality of primers is capable of amplifying substantially all V genes and substantially all J genes in a given adaptive immune receptor-encoding locus (e.g., a human TCR or IgH locus). Such primer sets permit generation, in multiplexed (e.g., using multiple forward and reverse primer pairs) PCR, of amplification products that have a first end that is encoded by a rearranged V region-encoding gene segment and a second end that is encoded by a J region-encoding gene segment.

Typically and in certain embodiments, such amplification products may include a CDR3-encoding sequence although the invention is not intended to be so limited and contemplates amplification products that do not include a CDR3-encoding sequence. The primers may be preferably designed to yield amplification products having sufficient portions of V and J sequences and/or of V-J barcode (B) sequences as described herein, such that by sequencing the products (amplicons), it is possible to identify on the basis of sequences that are unique to each gene segment (i) the particular V gene, and (ii) the particular J gene in the proximity of which the V gene underwent rearrangement to yield a functional adaptive immune receptor-encoding gene. Typically, and in preferred embodiments, the PCR amplification products will not be more than 600 base pairs in size, which according to non-limiting theory will exclude amplification products from non-rearranged adaptive immune receptor genes. In certain other preferred embodiments the amplification products will not be more than 500, 400, 300, 250, 200, 150, 125, 100, 90, 80, 70, 60, 50, 40, 30 or 20 base pairs in size, such as may advantageously provide rapid, high-throughput quantification of sequence-distinct amplicons by short sequence reads.

In one embodiment of formula I, V is a polynucleotide sequence that encodes at least 10-70 contiguous amino acids of an adaptive immune receptor V-region, or the complement thereof; J is a polynucleotide sequence that encodes at least 5-30 contiguous amino acids of an adaptive immune receptor J-region, or the complement thereof; U1 and U2 are each either nothing or comprise an oligonucleotide comprising a nucleotide sequence that is selected from (i) a universal adaptor oligonucleotide sequence, and (ii) a sequencing platform-specific oligonucleotide sequence that is linked to and positioned 5' to the universal adaptor oligonucleotide sequence; B1, B2, and B3 are each independently either nothing or each comprise an oligonucleotide B that comprises an oligonucleotide barcode sequence of 3, 4, 5, 6, 7, 8, 9, 10, 11, 12, 13, 14, 15, 16, 17, 18, 19 or 20 contiguous nucleotides, wherein in each of the plurality of oligonucleotide sequences, B comprises a unique oligonucleotide sequence that uniquely identifies, as a paired combination, (i) the unique V oligonucleotide sequence and (ii) the unique J oligonucleotide sequence.

In another embodiment of formula (I), V is a polynucleotide sequence of at least 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400 or 450 and not more than 1000, 900, 800, 700, 600 or 500 contiguous nucleotides of an adaptive immune receptor (e.g., TCR or BCR) variable (V) region gene sequence, or the complement thereof, and in each of the plurality of oligonucleotide sequences V comprises a unique oligonucleotide sequence.

Additional description about synthetic template oligonucleotides can be found in International Application No. PCT/US2013/040221, filed May 8, 2013, which is incorporated by reference in its entirety.

FIG. 1A illustrates one example of a synthetic template oligonucleotide, according to an embodiment of the invention. In one embodiment, a synthetic template oligonucleotide comprises the following regions (left to right, as shown in FIG. 1): a universal primer sequence (UA) (102), a template-specific barcode (BC) (104), a sequence comprising a portion of or all of a unique adaptive immune receptor variable (V) region encoding gene sequence (V gene) (106), a synthetic template internal marker (IM) (108), a repeat of the barcode (BC) (104), a repeat of the internal marker (IM) (108), a sequence comprising a portion of or all of a unique adaptive immune receptor variable (J) region encoding gene sequence (J gene) (110), a third repeat of the barcode (BC) (104), and a reverse universal primer sequence (UB) (112). Each synthetic template oligonucleotide includes a unique adaptive immune receptor variable (V) region encoding gene sequence and unique adaptive immune receptor joining (J) region encoding gene sequence. The combination of V and J sequences on the synthetic template oligonucleotides are the same as those found in biological molecules comprising unique combinations of rearranged V and J sequences in the sample.

In one example, the synthetic template oligonucleotide can be a 495 bp sequence comprising a universal primer sequence (UA) (102), a 16 bp template-specific barcode (BC) (104), a 300 bp adaptive immune receptor variable (V) region encoding gene sequence (V gene) (106), a 9 bp synthetic template internal marker (IM) (108), a repeat of the barcode (BC) (104), a repeat of the internal marker (IM) (108), a 100 bp adaptive immune receptor variable (J) region encoding gene sequence (J gene) (110), a third repeat of the barcode (BC) (104), and a reverse universal primer sequence (UB) (112). Various lengths of the sequences and order of the regions can be used in designing the synthetic template oligonucleotides, as known by one skilled in the art.

The synthetic template oligonucleotides of Formula I can also include adaptor sequences. The adaptor sequences can be added to the synthetic template oligonucleotides by designing primers that include adaptor sequences at their 5'-ends and that specifically hybridize to the adaptor UA and UB regions on the synthetic template oligonucleotides (see FIG. 1(A). An example of an adaptor sequence is an Illumina adaptor sequence, as described in the section "Adaptors" below.

In one embodiment, the resulting synthetic template oligonucleotide amplicons have the structure of general formula I and can include an adaptor sequence or adaptor sequences (Illumina sequence), such that the sequence of the synthetic template oligonucleotide comprises the following: an adaptor sequence, a universal primer sequence (UA) (102), a template-specific barcode (BC) (104), an adaptive immune receptor variable (V) region encoding gene sequence (V gene) (106), a synthetic template internal marker (IM) (108), a repeat of the barcode (BC) (104), a repeat of the internal marker (IM) (108), an adaptive immune receptor variable (J) region encoding gene sequence (J gene) (110), a third repeat of the barcode (BC) (104), a reverse universal primer sequence (UB) (112), and a second adaptor sequence.

Number of Synthetic Template Oligonucleotides in Sample

In certain embodiments, the synthetic template composition comprises a plurality of distinct and unique synthetic template oligonucleotides. In one embodiment, the plurality of synthetic template oligonucleotides comprises at least a or at least b unique oligonucleotide sequences, whichever is larger, wherein a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide.

In another embodiment, the plurality of template oligonucleotides comprises at least (a×b) unique oligonucleotide sequences, where a is the number of unique adaptive immune receptor V region-encoding gene segments in the subject and b is the number of unique adaptive immune receptor J region-encoding gene segments in the subject, and the composition comprises at least one template oligonucleotide for every possible combination of a V region-encoding gene segment and a J region-encoding gene segment.

Accordingly, the composition may accommodate at least one occurrence of each unique V polynucleotide sequence and at least one occurrence of each unique J polynucleotide sequence, where in some instances the at least one occurrence of a particular unique V polynucleotide will be present in the same template oligonucleotide in which may be found the at least one occurrence of a particular unique J polynucleotide. Thus, for example, "at least one template oligonucleotide for each unique V polynucleotide and at least one template oligonucleotide for each unique J polynucleotide" may in certain instances refer to a single template oligonucleotide in which one unique V polynucleotide and one unique J polynucleotide are present.

In one embodiment, a is 1 to a number of maximum V gene segments in the mammalian genome of the subject. In another embodiment, b is 1 to a number of maximum J gene segments in the mammalian genome of the subject. In other embodiments, a is 1. In other embodiments, b is 1.

In some embodiments, a can range from 1 V gene segment to 54 V gene segments for TCRA, 1-76 V gene segments for TCRB, 1-15 V gene segments for TCRG, 1-7 V gene segments for TCRD, 1-165 V gene segments for IGH, 1-111 for IGK, or 1-79 V gene segments for IGL. In other embodiments, b can range from 1 J gene segment to 61 J gene segments for TCRA, 1-14 J gene segments for TCRB, 1-5 J gene segments for TCRG, 1-4 gene segments for TCRD, 1-9 J gene segments for IGH, 1-5 J gene segments for IGK, or 1-11 J gene segments for IGL. In certain embodiments, a pool of synthetic template oligonucleotides comprising every possible combination of a V region-encoding gene segment and a J region-encoding gene segment comprises 248 unique synthetic template types for TCRA/D, 858 unique synthetic types for TCRB, 70 unique synthetic template types for TCRG, 1116 unique synthetic template types for IGH, and 370 unique synthetic template types for IGK/L.

The table below lists the number of V gene segments (a) and J gene segments (b) for each human adaptive immune receptor loci, including functional V and J segments.

TABLE 1

Number of V gene segments (a) and J gene segments (b)

|      | V segments * | functional V segments ** | J segments * | Functional J segments ** |
|------|--------------|--------------------------|--------------|--------------------------|
| TCRA | 54           | 45                       | 61           | 50                       |
| TCRB | 76           | 48                       | 14           | 13                       |
| TCRG | 15           | 6                        | 5            | 5                        |
| TCRD | 7            | 7                        | 4            | 4                        |
| IGH  | 165          | 51                       | 9            | 6                        |
| IGK  | 111          | 44                       | 5            | 5                        |
| IGL  | 79           | 33                       | 11           | 7                        |

* Total variable and joining segment genes
** Variable and joining segment genes with at least one functional allele In some embodiments, the J polynucleotide of the synthetic template oligonucleotide comprises at least 15-30, 31-60, 61-90, 91-120, or 120-150, and not more than 600, 500, 400, 300 or 200 contiguous nucleotides of an adaptive immune receptor J constant region, or the complement thereof.

The presently contemplated invention is not intended to be so limited, however, such that in certain embodiments, a substantially fewer number of template oligonucleotides may advantageously be used. In these and related embodiments, where a is the number of unique adaptive immune receptor V region-encoding gene segments in a subject and b is the number of unique adaptive immune receptor J region-encoding gene segments in the subject, the minimum number of unique oligonucleotide sequences of which the plurality of synthetic template oligonucleotides is comprised may be determined by whichever is the larger of a and b, so long as each unique V polynucleotide sequence and each unique J polynucleotide sequence is present in at least one synthetic template oligonucleotide in the template composition. Thus, according to certain related embodiments, the template composition may comprise at least one synthetic template oligonucleotide for each unique V polynucleotide, e.g., that includes a single one of each unique V polynucleotide according to general formula (I), and at least one synthetic template oligonucleotide for each unique J polynucleotide, e.g., that includes a single one of each unique J polynucleotide according to general formula (I).

In certain other embodiments, the template composition comprises at least one synthetic template oligonucleotide to which each oligonucleotide amplification primer in an amplification primer set can anneal.

That is, in certain embodiments, the template composition comprises at least one synthetic template oligonucleotide having an oligonucleotide sequence of general formula (I) to which each V-segment oligonucleotide primer can specifically hybridize, and at least one synthetic template oligonucleotide having an oligonucleotide sequence of general formula (I) to which each J-segment oligonucleotide primer can specifically hybridize.

According to such embodiments, the oligonucleotide primer set that is capable of amplifying rearranged DNA encoding one or a plurality of adaptive immune receptors comprises a plurality a' of unique V-segment oligonucleotide primers and a plurality b' of unique J-segment oligonucleotide primers. The plurality of a' V-segment oligonucleotide primers are each independently capable of annealing or specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one adaptive immune receptor V region-encoding gene segment. The plurality of b' J-segment oligonucleotide primers are each independently capable of annealing or specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one adaptive immune receptor J region-encoding gene segment.

In some embodiments, a' is the same as a (described above for synthetic template oligonucleotides). In other embodiments, b' is the same as b (described above for synthetic template oligonucleotides).

Thus, in certain embodiments and as also discussed elsewhere herein, the present synthetic template composition may be used in amplification reactions with amplification primers that are designed to amplify all rearranged adaptive immune receptor encoding gene sequences, including those that are not expressed. In certain other embodiments, the template composition and amplification primers may be designed so as not to yield amplification products of rearranged genes that are not expressed (e.g., pseudogenes, orphons). It will therefore be appreciated that in certain embodiments only a subset of rearranged adaptive immune receptor encoding genes may desirably be amplified, such that suitable amplification primer subsets may be designed and employed to amplify only those rearranged V-J sequences that are of interest. In these and related embodiments, correspondingly, a synthetic template composition comprising only a subset of interest of rearranged V-J rearranged sequences may be used, so long as the synthetic template composition comprises at least one synthetic template oligonucleotide to which each oligonucleotide amplification primer in an amplification primer set can anneal. The actual number of synthetic template oligonucleotides in the template composition may thus vary considerably among the contemplated embodiments, as a function of the amplification primer set that is to be used.

For example, in certain related embodiments, in the template composition, the plurality of synthetic template oligonucleotides comprise sequences found in SEQ ID NOs: 787-1644.

Primers for Use with Synthetic Template Oligonucleotides

The polynucleotide V in general formula (I) (or its complement) includes sequences to which members of oligonucleotide primer sets specific for TCR or BCR genes can specifically anneal. Primer sets that are capable of amplifying rearranged DNA encoding a plurality of TCR or BCR are described, for example, in U.S. Ser. No. 13/217,126; U.S. Ser. No. 12/794,507; PCT/US2011/026373; or PCT/US2011/049012; or the like; or as described therein may be designed to include oligonucleotide sequences that can specifically hybridize to each unique V gene and to each J gene in a particular TCR or BCR gene locus (e.g., TCR α, β, γ or δ, or IgH μ, γ, δ, α or ε, or IgL κ or λ).

For example, by way of illustration and not limitation, an oligonucleotide primer of an oligonucleotide primer amplification set that is capable of amplifying rearranged DNA encoding one or a plurality of TCR or BCR may typically include a nucleotide sequence of 15, 16, 17, 18, 19, 20, 21, 22, 23, 24, 25, 26, 27, 28, 29, 30, 31, 32, 33, 34, 35, 36, 37, 38, 39 or 40 contiguous nucleotides, or more, and may specifically anneal to a complementary sequence of 15, 16, 17, 18, 19, 20, 21, 22, 23, 24, 25, 26, 27, 28, 29, 30, 31, 32, 33, 34, 35, 36, 37, 38, 39 or 40 contiguous nucleotides of a V or a J polynucleotide as provided herein. In certain embodiments the primers may comprise at least 19, 20, 21, 22, 23, 24, 25, 26, 27, 28, 29 or 30 nucleotides, and in certain embodiment the primers may comprise sequences of no more than 15, 16, 17, 18, 19, 20, 21, 22, 23, 24, 25, 26, 27, 28, 29, 30, 31, 32, 33, 34, 35, 36, 37, 38, 39 or 40 contiguous nucleotides. Primers and primer annealing sites of other lengths are also expressly contemplated, as disclosed herein.

The polynucleotide J in general formula (I) (or its complement) includes sequences to which members of oligonucleotide primer sets specific for TCR or BCR genes can specifically anneal. Primer sets that are capable of amplifying rearranged DNA encoding a plurality of TCR or BCR are described, for example, in U.S. Ser. No. 13/217,126; U.S. Ser. No. 12/794,507; PCT/US2011/026373; or PCT/US2011/049012; or the like; or as described therein may be designed to include oligonucleotide sequences that can specifically hybridize to each unique V gene and to each unique J gene in a particular TCR or BCR gene locus (e.g., TCR α, β, γ or δ, or IgH μ, γ, δ, α or ε, or IgL κ or λ).

These V-segment and J-segment oligonucleotide primers can comprise universal adaptor sequences at their 5'-ends for sequencing the resulting amplicons, as described above and in U.S. Ser. No. 13/217,126; U.S. Ser. No. 12/794,507; PCT/US2011/026373; or PCT/US2011/049012. FIG. 1B illustrates primers that hybridize to specific regions of the V-segment and J-segment sequences and also include universal adaptor sequences.

In certain embodiments, oligonucleotide primer sets for amplification may be provided in substantially equimolar amounts. As also described herein, according to certain other embodiments, the concentration of one or more primers in a primer set may be adjusted deliberately so that certain primers are not present in equimolar amounts or in substantially equimolar amounts.

Adaptors

The herein described template oligonucleotides of general formula (I) also may in certain embodiments comprise first (U1) (102) and second (U2) (112) universal adaptor oligonucleotide sequences, or may lack either or both of U1 (102) and U2 (112). U1 (102) thus may comprise either nothing or an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence, and U2 (112) may comprise either nothing or an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence.

U1 (102) and/or U2 (112) may, for example, comprise universal adaptor oligonucleotide sequences and/or sequencing platform-specific oligonucleotide sequences that are specific to a single-molecule sequencing technology being employed, for example the HiSeq™ or GeneAnalyzer™-2 (GA-2) systems (Illumina, Inc., San Diego, Calif.) or another suitable sequencing suite of instrumentation, reagents and software. Inclusion of such platform-specific adaptor sequences permits direct quantitative sequencing of the presently described template composition, which comprises a plurality of different template oligonucleotides of general formula (I), using a nucleotide sequencing methodology such as the HiSeq™ or GA2 or equivalent. This feature therefore advantageously permits qualitative and quantitative characterization of the template composition.

In particular, the ability to sequence all components of the template composition directly allows for verification that each template oligonucleotide in the plurality of template oligonucleotides is present in a substantially equimolar amount. For example, a set of the presently described template oligonucleotides may be generated that have universal adaptor sequences at both ends, so that the adaptor sequences can be used to further incorporate sequencing platform-specific oligonucleotides at each end of each template.

Without wishing to be bound by theory, platform-specific oligonucleotides may be added onto the ends of such modified templates using 5' (5'-platform sequence-universal adaptor-1 sequence-3') and 3' (5'-platform sequence-universal adaptor-2 sequence-3') oligonucleotides in as little as two cycles of denaturation, annealing and extension, so that the relative representation in the template composition of each of the component template oligonucleotides is not quantitatively altered. Unique identifier sequences (e.g., barcode sequences B comprising unique V and B oligonucleotide sequences that are associated with and thus identify, respectively, individual V and J regions, as described herein) are placed adjacent to the adaptor sequences, thus permitting quantitative sequencing in short sequence reads, in order to characterize the template population by the criterion of the relative amount of each unique template sequence that is present.

Where such direct quantitative sequencing indicates that one or more particular oligonucleotides may be over- or underrepresented in a preparation of the template composition, adjustment of the template composition can be made accordingly to obtain a template composition in which all oligonucleotides are present in substantially equimolar amounts. The template composition in which all oligonucleotides are present in substantially equimolar amounts may then be used as a calibration standard for amplification primer sets, such as in the presently disclosed methods for determining and correcting non-uniform amplification potential among members of a primer set.

When primers are tailed with the universal+Illumina adaptors and sequenced with Illumina adaptors (see FIG. 1), these templates behave in the same fashion as typical synthetic templates. When amplified using VF and JR multiplex PCR primers and sequenced with JR primers, these molecules produce a sequencing read with the following structure (5' to 3'): (1) J gene sequence (about 15 base pairs), (2) a 9 base pair synthetic template internal marker (IM), (3) a 16 base pair V-J barcode (BC), (4) a second 9 base pair synthetic template internal marker (IM), and (5) a V gene (about 15 base pairs).

In addition to adaptor sequences described in SEQ ID NOs: 765-786, other oligonucleotide sequences that may be used as universal adaptor sequences will be known to those familiar with the art in view of the present disclosure, including selection of adaptor oligonucleotide sequences that are distinct from sequences found in other portions of the herein described templates.

Barcodes

As described herein, certain embodiments contemplate designing the template oligonucleotide sequences to contain short signature sequences that permit unambiguous identification of the template sequence, and hence of at least one primer responsible for amplifying that template, without having to sequence the entire amplification product. In the herein described synthetic template oligonucleotides of general formula (I), B1, B2, B3, and B4 are each independently either nothing or each comprises an oligonucleotide B that comprises an oligonucleotide barcode sequence of 3, 4, 5, 6, 7, 8, 9, 10, 11, 12, 13, 14, 15, 16, 17, 18, 19, 20, 25, 30, 35, 40, 45, 50, 60, 70, 80, 90, 100, 200, 300, 400, 500, 600, 700, 800, 900 or 1000 or more contiguous nucleotides (including all integer values therebetween), wherein in each of the plurality of template oligonucleotide sequences B comprises a unique oligonucleotide sequence that uniquely identifies, as a paired combination, (i) the unique V oligonucleotide sequence of the template oligonucleotide and (ii) the unique J oligonucleotide sequence of the template oligonucleotide.

Thus, for instance, synthetic template oligonucleotides having barcode identifier sequences may permit relatively short amplification product sequence reads, such as barcode sequence reads of no more than 1000, 900, 800, 700, 600, 500, 400, 300, 200, 100, 90, 80, 70, 60, 55, 50, 45, 40, 35, 30, 25, 20, 19, 18, 17, 16, 15, 14, 13, 12, 11, 10, 9, 8, 7, 6, 5, 4 or fewer nucleotides, followed by matching this barcode sequence information to the associated V and J sequences that are incorporated into the template having the barcode as part of the template design. By this approach, a large number of amplification products can be simultaneously partially sequenced by high throughput parallel sequencing, to identify primers that are responsible for amplification bias in a complex primer set.

Exemplary barcodes may comprise a first barcode oligonucleotide of 5, 6, 7, 8, 9, 10, 11, 12, 13, 14, 15 or 16 nucleotides that uniquely identifies each V polynucleotide in the template and a second barcode oligonucleotide of 5, 6, 7, 8, 9, 10, 11, 12, 13, 14, 15 or 16 nucleotides that uniquely identifies each J polynucleotide in the template, to provide barcodes of, respectively, 10, 11, 12, 13, 14, 15, 16, 17, 18, 19, 20, 21, 22, 23, 24, 25, 26, 27, 28, 29, 30, 31 or 32 nucleotides in length, but these and related embodiments are not intended to be so limited. Barcode oligonucleotides may comprise oligonucleotide sequences of any length, so long as a minimum barcode length is obtained that precludes occurrence of a given barcode sequence in two or more template oligonucleotides having otherwise distinct sequences (e.g., V and J sequences).

Thus, the minimum barcode length, to avoid such redundancy amongst the barcodes that are used to uniquely identify different V-J sequence pairings, is X nucleotides, where $4^X$ is greater than the number of distinct template species that are to be differentiated on the basis of having non-identical sequences. For example, for the set of 858 template oligonucleotides set forth in SEQ ID NOs: 1888-3003, the minimum barcode length would be five nucleotides, which would permit a theoretical total of 1024 (i.e., greater than 871) different possible pentanucleotide sequences. In practice, barcode oligonucleotide sequence read lengths may be limited only by the sequence read-length limits of the nucleotide sequencing instrument to be employed. For certain embodiments, different barcode oligonucleotides that will distinguish individual species of template oligonucleotides should have at least two nucleotide mismatches (e.g., a minimum hamming distance of 2) when aligned to maximize the number of nucleotides that match at particular positions in the barcode oligonucleotide sequences.

In preferred embodiments, for each distinct template oligonucleotide species having a unique sequence within the template composition of general formula (I), B1, B2, B3, and B4 will be identical.

The skilled artisan will be familiar with the design, synthesis, and incorporation into a larger oligonucleotide or polynucleotide construct, of oligonucleotide barcode sequences of, for instance, at least 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 70, 80, 90, 100, 200, 300, 300, 500 or more contiguous nucleotides, including all integer values therebetween. For non-limiting examples of the design and implementation of oligonucleotide barcode sequence identification strategies, see, e.g., de Carcer et al., 2011 *Adv. Env. Microbiol.* 77:6310; Parameswaran et al., 2007 *Nucl. Ac. Res.* 35(19):330; Roh et al., 2010 *Trends Biotechnol.* 28:291.

Typically, barcodes are placed in templates at locations where they are not found naturally, i.e., barcodes comprise nucleotide sequences that are distinct from any naturally occurring oligonucleotide sequences that may be found in the vicinity of the sequences adjacent to which the barcodes are situated (e.g., V and/or J sequences). Such barcode sequences may be included, according to certain embodiments described herein, as elements B1, B2 and/or B3 of the presently disclosed template oligonucleotide of general formula (I). Accordingly, certain of the herein described template oligonucleotides of general formula (I) may also in certain embodiments comprise one, two or all three of barcodes B1, B2 and B3, while in certain other embodiments some or all of these barcodes may be absent. In certain embodiments all barcode sequences will have identical or similar GC content (e.g., differing in GC content by no more than 20%, or by no more than 19, 18, 17, 16, 15, 14, 13, 12, 11 or 10%).

In the template compositions according to certain herein disclosed embodiments the barcode-containing element B (e.g., B1, B2, B3, and/or B4) comprises the oligonucleotide sequence that uniquely identifies a single paired V-J combination. Optionally and in certain embodiments the barcode-containing element B may also include a random nucleotide, or a random polynucleotide sequence of at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 70, 80, 90, 100, 200, 300, 300, 500 or more contiguous nucleotides, situated upstream and/or downstream of the specific barcode sequence that uniquely identifies each specific paired V-J combination. When present both upstream and downstream of the specific barcode sequence, the random nucleotide or random polynucleotide sequence are independent of one another, that is, they may but need not comprise the same nucleotide or the same polynucleotide sequence.

Randomers

In some embodiments, the synthetic template oligonucleotide comprises a randomly generated oligonucleotide sequence, or a "randomer" sequence. The randomer sequence is generally situated between the V and J sequences, but can be located elsewhere along the synthetic template oligonucleotide. In an embodiment, the randomer sequence only occurs once in the synthetic template. N comprises a random oligonucleotide sequence of 5, 6, 7, 8, 9, 10, 11, 12, 13, 14, 15, 16, 17, 18, 19, 20, 21, 22, 23, 24, 25, 26, 27, 28, 29, 30, or more than 30 contiguous nucleotides.

The number of possible nucleotide sequences of length X is $4^X$, thus a random nucleotide segment of even a short length may encode many possible unique nucleotide sequences. For example, a randomer sequence of 12 base pairs could encode any one of 16,777,216 unique nucleotide sequences. The randomer sequence ensures that any two synthetic template oligonucleotides have a probability of about 1 in 17 million of containing the same randomer sequence. Thus, tens or hundreds of thousands of synthetic template oligonucleotides can be included in the PCR reaction with minimal to no overlap in randomer sequences between two distinct synthetic template oligonucleotides.

Randomer sequences allow each synthetic template oligonucleotide to be quantitated exactly. Upon amplification of a pool of synthetic template oligonucleotides, each unique random nucleotide sequence observed in the sequencing output represents a single molecule of input material. Thus, the input number of synthetic template oligonucleotides added to the amplification reaction can be determined by counting the number of unique random nucleotide sequences. Furthermore, the input number of synthetic template oligonucleotides associated with a particular barcode (and thus associated with a particular paired combination of a V oligonucleotide sequence and J oligonucleotide sequence) can be determined by counting the number of unique random nucleotide sequences associated with a particular barcode. Examples of synthetic templates comprising randomers can be found, for example, in SEQ ID NOs: 3004-3159.

Restriction Enzyme Sites

According to certain embodiments disclosed herein, the template oligonucleotide can also comprise a restriction endonuclease (RE) recognition site that is situated between the V and J sequences and does not occur elsewhere in the template oligonucleotide sequence. The RE recognition site may optionally be adjacent to a barcode site that identifies the V region sequence. The RE site may be included for any of a number of purposes, including without limitation as a structural feature that may be exploited to destroy templates selectively by contacting them with the appropriate restriction enzyme. It may be desirable to degrade the present template oligonucleotides selectively by contacting them with a suitable RE, for example, to remove template oligonucleotides from other compositions into which they may have been deliberately or accidentally introduced. Alternatively, the RE site may be usefully exploited in the course of sequencing template oligonucleotides in the template composition, and/or as a positional sequence marker in a template oligonucleotide sequence regardless of whether or not it is cleaved with a restriction enzyme. An exemplary RE site is the oligonucleotide motif GTCGAC, which is recognized by the restriction enzyme Sal I. A large number of additional restriction enzymes and their respective RE recognition site sequences are known in the art and are available commercially (e.g., New England Biolabs, Beverly, Mass.). These include, for example, EcoRI (GAATTC) and SphI (GCATGC). Those familiar with the art will appreciate that any of a variety of such RE recognition sites may be incorporated into particular embodiments of the presently disclosed template oligonucleotides.

Control Synthetic Template Compositions Useful for Quantifying a Relative Representation of Adaptive Immune Cells in a Biological Sample Control synthetic template oligonucleotides can be designed to quantify a number of input molecules in a biological sample. These control synthetic template oligonucleotides are similar to the synthetic template oligonucleotides described above, but do not contain a V oligonucleotide sequence or a J oligonucleotide sequence. When referring to synthetic templates, often the V and J region-containing oligonucleotides are referred to as a "first" set of synthetic templates while control synthetic templates are often referred to as a "second" set of synthetic templates. Instead, a control synthetic template composition comprises a plurality of template oligonucleotides of general formula (II):

5'-U1-B1-X1-B2-N-X2-B3-U2-3'    (II).

The segments U1, B1, B2, N, B3, and U2 are the same as described above. In an embodiment, X1 and X2 are either nothing or each comprise a polynucleotide comprising at least 10, 20, 30, or 40, and not more than 1000, 900, or 800 contiguous nucleotides of a DNA sequence. In some embodiments, the DNA sequence is of a genomic control gene (also referred to as an "internal control gene"), or the complement thereof. As used herein "genomic control gene" or "internal control gene" is any gene that is found in all cells (including both adaptive immune cells and cells that are not adaptive immune cells), such as a housekeeping gene like RNase P, PSMB2, RAB7A, UBC, VCP, REEF5, or EMC7.

Synthetic template oligonucleotides of formula (I) are used to determine a total number of input adaptive immune receptor molecules (and thus adaptive immune cells) in a biological sample. As explained below, control synthetic template oligonucleotides of formula (II) can be used to determine the total number of all input genomes in a biological sample, the biological sample including adaptive immune cells and cells that are not adaptive immune cells.

In some embodiments, a control synthetic template composition comprises one of the sequences found in SEQ ID NOs: 3160-3166 and 3241-3152. SEQ ID NOs: 3167-3194 show exemplary sequencing primers for control synthetic template compositions containing various control gene segments, SEQ ID NOs: 3195-3222 are exemplary primer sequences for adaptor sequences of the control synthetic template compositions, and SEQ ID NOs: 3223-3236 are exemplary primer sequences specific for the control synthetic template compositions. FIGS. 1A and 1B illustrate one example of a control synthetic template oligonucleotide, according to an embodiment of the invention.

In certain embodiments it is advantageous for the control synthetic control templates to be of similar length to synthetic templates containing TCR and/or Ig V and J or C segments. Furthermore, it is also advantageous in many embodiments for the synthetic templates (both control templates and those containing biological TCR or Ig sequences) to be of similar length to the amplification product of the TCR/Ig loci and the genomic control region from the input sample. In some embodiments, the length of the synthetic templates and corresponding amplicons from biological material are between about 100 and about 300 nucleotides (for example, 100, 110, 120, 130, 140, 150, 160, 170, 180, 190, 200, 210, 220, 230, 240, 250, 260, 270, 280, 290, or 300 nucleotides).

Methods of Use

I. Methods for Quantifying Tumor Infiltrating Lymphocytes without Randomers a. Determining the Number of Input Synthetic Template Oligonucleotides in a Sample and an Amplification Factor Using a Limiting Dilution of Synthetic Template Oligonucleotides In some embodiments, methods of the invention comprise determining the number of input synthetic template oligonucleotides in a sample and determining the amplification factor for each unique synthetic template.

The methods include steps for determining a number of synthetic template oligonucleotides added to a starting sample for use in PCR. The number of input synthetic template oligonucleotides can be estimated by using a limiting dilution of synthetic template oligonucleotides in a multiplex PCR assay. This number of input synthetic template oligonucleotides into a PCR assay and the number of output sequencing reads produced from the PCR assay can then be used to calculate an amplification ratio.

A limiting dilution is achieved when the amount of DNA in a sample is diluted to the point where only a very small subset of synthetic template oligonucleotides is present in the dilution. For example, in a pool of 1000 unique synthetic template oligonucleotides, the limiting dilution can include only 100 of the 1000 unique synthetic template oligonucleotides. Most of the unique synthetic templates would be absent in the limiting dilution. For example, the limiting dilution can include only 100 unique types of synthetic template oligonucleotide and only 1 copy of each unique synthetic template oligonucleotide. Thus, a portion of unique synthetic template oligonucleotides are added as a single copy or only a small number of copies, and the rest of the synthetic template oligonucleotides in the pool are added at zero copies (i.e., absent). In certain embodiments, the limiting dilution of the unique synthetic template oligonucleotides includes one molecule of each detectable, unique synthetic template oligonucleotide. In other embodiments, the limiting dilution can include two molecules of one or more of the detectable, unique synthetic template oligonucleotides. Thus, the limiting dilution includes a very low concentration of unique synthetic template oligonucleotides.

The limiting dilution of synthetic template oligonucleotides is amplified as part of a multiplex PCR, and the number of unique types of synthetic template oligonucleotide amplicons (having a unique barcode sequence, for example) is calculated.

Simplex PCR allows for amplification of each unique synthetic template oligonucleotide using one pair of PCR primers for all synthetic templates in the complete pool of synthetic template oligonucleotides. Simplex PCR can be performed on the synthetic template oligonucleotides by using universal primers that include the adaptor sequences and hybridize to the universal primer sequences (UA (102) and UB (112), as shown in FIG. 1B). Then, the resulting library of synthetic template oligonucleotide amplicons can be individually sequenced using the adaptor sequences on each amplicon on a sequencer, such as an Illumina sequencer. This process allows the direct measurement of the frequency of each synthetic template oligonucleotide in the complex pool.

Figure 2:
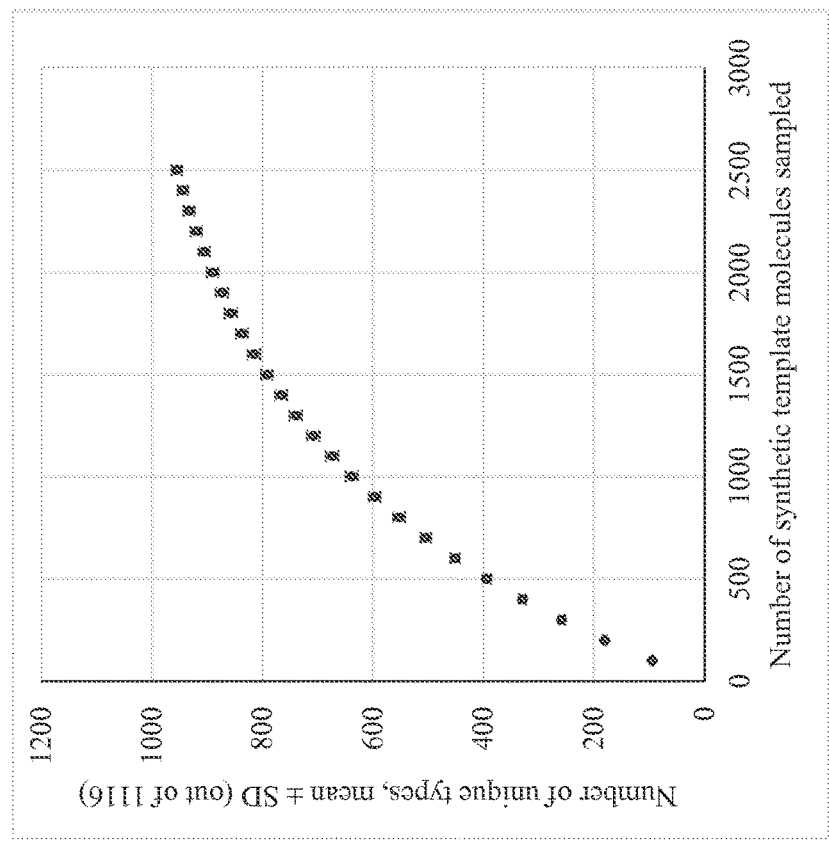
FIG. 2 is a graph showing the relationship between the number of unique synthetic template oligonucleotides and the total number of synthetic template oligonucleotides in a sample, according to one embodiment of the invention.

In certain embodiments, an in silico simulation is used to analyze the relationship between the number of unique synthetic template oligonucleotide amplicons sequenced from the limiting dilution used in a multiplex PCR reaction and the estimated total input number of synthetic template oligonucleotides added to said multiplex PCR reaction. FIG. 2 provides an in silico simulation of the relationship between the number of unique types of synthetic template oligonucleotides observed (e.g., sequenced from the sample) and the number of synthetic template molecules sampled (e.g., number of synthetic template oligonucleotides in the starting sample). For example, if 400 unique types of synthetic template oligonucleotides are sequenced and observed from the sample, it can be determined that the starting sample included approximately 500 synthetic template oligonucleotide molecules. Accordingly, the total number of input synthetic template oligonucleotide can be determined from the number of unique synthetic template oligonucleotides observed.

A portion of this pool of synthetic template oligonucleotides can then be added into a multiplex PCR reaction comprising biological rearranged TCR or IG nucleic acid molecules obtained from lymphocytes in a given sample. The determined number of added ("spiked in") synthetic template oligonucleotides and the calculated amplification ratio can be used to determine a total number of lymphocytes in the sample.

As described in detail herein, subsequent to the characterization of the synthetic template oligonucleotide pool, a limiting dilution of this pool can be added to a biological sample to determine the number of B or T cells present in said biological sample. An amplification factor is determined based on the number of synthetic template oligonucleotides in a starting sample of synthetic template oligonucleotides that has been added to a biological sample.

The amplification factor is calculated by comparing the number of total sequencing reads for synthetic template oligonucleotides observed from a sample with the total number of input synthetic template oligonucleotides in the sample. The amplification factor can then be used to determine the number of total lymphocytes (T cells or B cells) in a biological sample. This amplification factor can be assumed to apply to biological templates (e.g., rearranged TCR or IG nucleic acid molecules) that have been amplified with the same V-segment and J-segment-specific primers used to amplify synthetic template oligonucleotide molecules.

In an embodiment, the amplification factor (ratio) of the number of sequencing reads of synthetic template oligonucleotide amplicons to the number of total input synthetic template oligonucleotide molecules is compared to the number of total sequencing reads of biological molecule amplicons in order to calculate the starting number of input biological molecules. Thus, calculating the number of synthetic template oligonucleotide molecules at the start of the PCR assay can then be used in calculations of the relative representation of adaptive immune cells in the sample, as described in detail below.

b. Methods for Determining the Absolute Representation of Adaptive Immune Cells in a Sample Methods are provided for determining the absolute representation of rearranged adaptive immune receptor encoding sequences in a sample.

Methods of the invention include extracting biological nucleic acid molecules (e.g., rearranged TCR or IG DNA molecules) from a biological sample comprising adaptive immune cells and cells that are not adaptive immune cells. The biological nucleic acid molecules in the sample are "spiked" with a known amount of synthetic template oligonucleotides (e.g., as described above in Section I. a. and determined by limiting dilution). The synthetic template oligonucleotides comprise the same combinations of V-segment and J-segment oligonucleotide sequences as the biological nucleic acid molecule templates.

In certain embodiments, the method for quantifying the absolute number of rearranged DNA molecules encoding a plurality of adaptive immune receptors in a biological sample of a subject, comprises the following steps:

I. Amplifying, in a multiplex PCR assay, a subset of synthetic template oligonucleotide molecules obtained from a pool of synthetic template oligonucleotides, the subset of synthetic template oligonucleotide molecules diluted such that only a single copy or a small number of copies of a portion of unique synthetic template oligonucleotides is present. The amplified synthetic template oligonucleotides are sequenced, and the number of unique synthetic template oligonucleotides based on unique barcode sequences is determined. The number of total sequencing reads from the synthetic template oligonucleotides is also determined from the sequencing output. Next, the results of an in silico simulation based on previous characterization of the synthetic template oligonucleotide pool (by simplex PCR) is referenced to determine from the number of unique synthetic template oligonucleotide sequences, the total input number of synthetic template oligonucleotide molecules (e.g., based on the relationship shown in FIG. 2). An amplification factor is determined from the ratio of the total output of sequencing reads from the sample and the estimated total number of input synthetic template oligonucleotides. This amplification factor can be used to estimate the total number of biological rearranged molecules, and thus, the total number of lymphoid cells, in a given sample. This can be done by adding ("spiking in") a small portion of the pool of dilute synthetic template oligonucleotides to the multiplex PCR.

II. Amplifying nucleic acid molecules obtained from a given sample, in a multiplex PCR, using an oligonucleotide amplification primer set comprising V-segment and J-segment primers as described herein that are capable of amplifying substantially all V-segment and J-segment combinations of rearranged adaptive immune receptors, the sample comprising i) rearranged biological TCR or Ig adaptive immune receptor nucleic acid molecules, each comprising a V region and a J region, and ii) a portion of "spiked in" synthetic template oligonucleotides as described above having a known input amount, thereby generating amplicons comprising a plurality of uniquely rearranged TCR or Ig adaptive immune receptor amplicons and a plurality of synthetic template amplicons.

III. Quantitatively sequencing the plurality of uniquely rearranged TCR or Ig adaptive immune receptor amplicons and a plurality of synthetic template amplicons generated in (I) to determine the total number of rearranged TCR or Ig adaptive immune receptor amplicons observed by sequencing (herein referred to as $A_i$) and the total number of synthetic template amplicons observed by sequencing (herein referred to as $A_{ii}$). The sequencing information includes the number of output sequencing products from the plurality of rearranged TCR or Ig adaptive immune receptor amplicons ($A_i$) and the number of output sequencing products from the synthetic template amplicons ($A_{ii}$).

IV. Determining an absolute representation of adaptive immune cells in the sample based on the quantitative sequencing information determined from step II.

To determine the absolute representation of adaptive immune cells, an amplification factor is first calculated. The amplification factor is the ratio of the number of output sequencing products from the synthetic template amplicons ($A_{ii}$) with the known number of input synthetic template oligonucleotides (referred to herein as $A_{iii}$). The number of input synthetic template oligonucleotides can be determined based on the in silico simulation performed in (I) to determine the relationship between the number of unique synthetic template oligonucleotide amplicons and the total input number of synthetic template oligonucleotides. It is assumed that the amplification factor of a particular primer set for a synthetic template oligonucleotide is the same amplification factor for the biological template.

Amplification factor=$A_{ii}/A_{iii}$=number of output sequencing products from the synthetic template amplicons/known number of input synthetic template oligonucleotides.

In calculating this amplification factor, it is assumed that the ratio of the number of output sequencing reads per molecule of input is the same for a synthetic template oligonucleotide molecule and a biological rearranged TCR or Ig adaptive immune receptor nucleic acid molecule.

After calculating the amplification factor, the total number of rearranged TCR or Ig adaptive immune receptor molecules in the sample, and accordingly, the total number of lymphocyte cells, can be determined.

In an embodiment, the number of biological rearranged nucleic acid molecules encoding adaptive immune receptors is determined by the following:

Number of rearranged nucleic acid molecules encoding adaptive immune receptors=$A_i/(A_{ii}/A_{iii})$=(Number of output sequencing products determined from the plurality of rearranged TCR or Ig adaptive immune receptor amplicons)/(Amplification factor)

The total number of rearranged nucleic acid molecules encoding adaptive immune receptors is equal to the total number of adaptive immune cells (e.g., T cells or B cells) in the sample. Accordingly, the total number of adaptive immune cells in the sample can be determined.

c. Determining the Relative Representation of Adaptive Immune Cells in a Complex Mixture of Cells Methods of the invention include determining a relative representation of adaptive immune cells in a complex mixture of cells that include adaptive immune cells and cells that are not adaptive immune cells. In some embodiments, the total number of adaptive immune cells is determined as described in Section I. b. and then used to calculate the relative representation of adaptive immune cells in the total sample of cells.

The total number of rearranged nucleic acid molecules encoding adaptive immune receptors (or total number of adaptive immune cells) is used to determine the relative representation of adaptive immune cells in the complex mixture. In one embodiment, the total mass of DNA in the sample is used to quantify the total number of genomes (adaptive immune cells and non-adaptive immune cells) in the complex mixture. Assuming that each cell has approximately 6.5 picograms of DNA and given a known total mass of input DNA to the PCR assay, the total number of total adaptive immune cells and non-adaptive immune cells in the sample is quantified by dividing the total known mass of input DNA by 6.5 picograms. This results in the relative representation of adaptive immune cells in the complex mixture of cells that include adaptive immune cells and cells that are not adaptive immune cells.

In other words, the relative representation of adaptive immune cells=total number of rearranged nucleic acid molecules encoding adaptive immune receptors/(total mass of DNA representing adaptive immune cells and non-adaptive immune cells).

Various other calculations as known to those of skill in the art can be used to determine the relative representation of adaptive immune cells in a complex mixture.

II. Methods for Quantifying Tumor Infiltrating Lymphocytes in a Sample Using Randomers and Control Genes a. Determining the Number of Input Synthetic Template Oligonucleotides in a Sample and an Amplification Factor In some embodiments, methods of the invention include determining a number of synthetic template oligonucleotides added to an input sample for use in PCR. The number of input synthetic template oligonucleotides can be estimated by amplifying a pool of synthetic template oligonucleotides that include randomers in a multiplex PCR assay, and counting the number of unique randomers observed in the nucleotide sequencing output. Since each synthetic template oligonucleotide in the input sample has a unique randomer sequence, each unique randomer sequence represents a single molecule, and the number of unique randomers in the nucleotide sequencing output represents the number of input synthetic template oligonucleotides.

In an embodiment, the input number of synthetic template oligonucleotides associated with a particular barcode (and thus associated with a particular paired combination of a V oligonucleotide sequence and J oligonucleotide sequence) can also be determined by counting the number of unique random DNA sequences associated with a particular barcode. The quantified number of input synthetic template oligonucleotides and the total number of output sequencing reads produced from the PCR assay can be used to calculate an amplification factor.

The amplification factor is determined based on the number of synthetic template oligonucleotides in a starting sample of synthetic template oligonucleotides that has been added to a biological sample. The amplification factor is calculated by comparing the number of total sequencing reads for synthetic template oligonucleotides observed from a sample with the total number of input synthetic template oligonucleotides in the sample, and can be used to determine the number of total lymphocytes (T cells or B cells) in a biological sample. This amplification factor can be assumed to apply to biological templates (e.g., rearranged TCR or IG nucleic acid molecules) that have been amplified with the same V-segment and J-segment-specific primers used to amplify synthetic template oligonucleotide molecules. In one embodiment, the amplification factor can also be defined as being based on the number of synthetic template oligonucleotides associated with a particular paired combination of a V oligonucleotide sequence and J oligonucleotide sequence in a biological sample. Thus, the amplification factor is calculated by comparing the number of total sequencing reads for synthetic template oligonucleotides associated with the particular paired combination, with the total number of input synthetic template oligonucleotides associated with the particular paired combination in the sample. This amplification factor can be used to determine the number of total lymphocytes (T cells or B cells) carrying the particular paired combination in a biological sample.

In an embodiment, the amplification factor (ratio) of the number of sequencing reads of synthetic template oligonucleotide amplicons to the number of total input synthetic template oligonucleotide molecules is compared to the number of total sequencing reads of biological molecule amplicons in order to calculate the starting number of input biological molecules. The number of synthetic template oligonucleotide molecules at the start of the PCR assay can then be used in calculations of the relative representation of adaptive immune cells in the sample, as described in detail below.

b. Methods for Determining the Absolute Representation of Adaptive Immune Cells in a Sample Methods are provided for determining the absolute representation of rearranged adaptive immune receptor encoding sequences in a sample.

Methods of the invention include extracting biological nucleic acid molecules (e.g., rearranged TCR or IG DNA molecules) from a biological sample comprising adaptive immune cells and cells that are not adaptive immune cells. The biological nucleic acid molecules in the sample are "spiked" with synthetic template oligonucleotides. The synthetic template oligonucleotides comprise the same combinations of V-segment and J-segment oligonucleotide sequences as the biological nucleic acid molecule templates.

In certain embodiments, the method for quantifying the absolute number of rearranged DNA molecules encoding a plurality of adaptive immune receptors in a biological sample of a subject, comprises the following steps:

I. Amplifying nucleic acid molecules obtained from a given sample, in a multiplex PCR using an oligonucleotide amplification primer set comprising V-segment and J-segment primers as described herein capable of amplifying substantially all V-segment and J-segment combinations of rearranged adaptive immune receptors, the sample comprising i) rearranged TCR or IG adaptive immune receptor nucleic acid molecules, each comprising a V region and a J region, and ii) synthetic template oligonucleotides as described above, thereby generating amplicons comprising a plurality of uniquely rearranged TCR or IG adaptive immune receptor amplicons and a plurality of synthetic template amplicons.

II. Quantitatively sequencing the plurality of uniquely rearranged TCR or IG adaptive immune receptor amplicons and a plurality of synthetic template amplicons generated in (I) to determine the total number of rearranged TCR or IG adaptive immune receptor amplicons observed by sequencing (herein referred to as $A_i$) and the total number of synthetic template amplicons observed by sequencing (herein referred to as $A_{ii}$). The sequencing information includes the number of output sequencing products from the plurality of rearranged TCR or Ig adaptive immune receptor amplicons ($A_i$) and the number of output sequencing products from the synthetic template amplicons ($A_{ii}$).

III. Determining an absolute representation of adaptive immune cells in the sample based on the quantitative sequencing information determined from step II.

To determine the absolute representation of adaptive immune cells, an amplification factor is first calculated. The amplification factor is the ratio of the number of output sequencing products from the synthetic template amplicons ($A_{ii}$) with the number of input synthetic template oligonucleotides (referred to herein as $A_{iii}$), calculated by counting the number of output synthetic template oligonucleotides having unique randomer sequences. It is assumed that the amplification factor of a particular primer set for a synthetic template oligonucleotide is the same amplification factor for the biological template.

Amplification factor=$A_{ii}/A_{iii}$=number of output sequencing products from the synthetic template amplicons/known number of input synthetic template oligonucleotides.

In calculating this amplification factor, it is assumed that the ratio of the number of output sequencing reads per molecule of input is the same for a synthetic template oligonucleotide molecule and a biological rearranged TCR or Ig adaptive immune receptor nucleic acid molecule.

After calculating the amplification factor, the total number of rearranged TCR or Ig adaptive immune receptor molecules in the sample, and accordingly, the total number of lymphocyte cells, can be determined.

In an embodiment, the number of biological rearranged nucleic acid molecules encoding adaptive immune receptors is determined by the following:

Number of rearranged nucleic acid molecules encoding adaptive immune receptors=$A_i/(A_{ii}/A_{iii})$=(Number of output sequencing products determined from the plurality of rearranged TCR or Ig adaptive immune receptor amplicons)/(Amplification factor)

The total number of rearranged nucleic acid molecules encoding adaptive immune receptors is equal to the total number of adaptive immune cells (e.g., T cells or B cells) in the sample. Accordingly, the total number of adaptive immune cells in the sample can be determined.

c. Determining the Relative Representation of Adaptive Immune Cells in a Complex Mixture of Cells Methods of the invention include determining a relative representation of adaptive immune cells in a complex mixture of cells that include adaptive immune cells and cells that are not adaptive immune cells. In some embodiments, the total number of adaptive immune cells is determined as described in the section above and then used to calculate the relative representation of adaptive immune cells in the total sample of cells.

In certain embodiments, the method for quantifying the relative representation of adaptive immune cells in a complex mixture of cells is similar to the method described above for quantifying the absolute number of rearranged DNA molecules. However, the method for quantifying the relative representation includes the use of control synthetic template oligonucleotides and control gene segment primers to determine the total number of input genomes in a biological sample. The method comprises the following steps:

I. Amplifying nucleic acid molecules obtained from a given sample, in a multiplex PCR using an oligonucleotide amplification primer set comprising V-segment and J-segment primers as described herein capable of amplifying substantially all V-segment and J-segment combinations of rearranged adaptive immune receptors, and a control gene segment primer set comprising a plurality of primers capable of amplifying at least a portion of a control gene that is found in adaptive immune cells and cells that are not adaptive immune cells. The given sample comprises i) rearranged TCR or IG adaptive immune receptor nucleic acid molecules, each comprising a V region and a J region, ii) synthetic template oligonucleotides as described above, iii) control gene segment molecules, and iv) control synthetic template oligonucleotides as described above, thereby generating amplicons comprising a plurality of uniquely rearranged TCR or IG adaptive immune receptor amplicons, a plurality of control gene segment amplicons, a plurality of synthetic template amplicons, and a plurality of control synthetic template amplicons.

II. Quantitatively sequencing the plurality of uniquely rearranged TCR or Ig adaptive immune receptor amplicons, the plurality of control gene segment amplicons, the plurality of synthetic template amplicons, and the plurality of control synthetic template amplicons generated in (I) to determine the total number of rearranged TCR or Ig adaptive immune receptor amplicons observed by sequencing (herein referred to as $A_i$), the total number of synthetic template amplicons observed by sequencing (herein referred to as $A_{ii}$), the total number of control gene segment amplicons observed by sequencing (herein referred to as $B_i$), and the total number of control synthetic template amplicons observed by sequencing (herein referred to as $B_{ii}$). The sequencing information includes the number of output sequencing products from the plurality of rearranged TCR or Ig adaptive immune receptor amplicons ($A_i$), the number of output sequencing products from the synthetic template amplicons ($A_{ii}$), the number of output sequencing products from the control gene segment amplicons ($B_i$), and the number of output sequencing products from the control synthetic template amplicons ($B_{ii}$).

III. Determining an absolute representation of adaptive immune cells in the sample based on the quantitative sequencing information determined from step II. This determination of the absolute representation of adaptive immune cells is described in detail above.

IV. Determining an absolute representation of total cells (adaptive immune cells and cells that are not adaptive immune cells) in the sample based on the quantitative sequencing information determined from step II.

To determine the absolute representation of total cells, a control amplification factor is first calculated. The control amplification factor is the ratio of the number of output sequencing products from the control synthetic template amplicons ($B_{ii}$) with the number of input control synthetic template oligonucleotides (referred to herein as $B_{iii}$), calculated by counting the number of output control synthetic template oligonucleotides having unique randomer sequences. It is assumed that the control amplification factor for the control synthetic template oligonucleotide is the same amplification factor for the biological template.

Control amplification factor=$B_{ii}/B_{iii}$=number of output sequencing products from the control synthetic template amplicons/number of input control synthetic template oligonucleotides.

In calculating this control amplification factor, it is assumed that the ratio of the number of output sequencing reads per molecule of input is the same for a control synthetic template oligonucleotide molecule and a biological control gene segment molecule.

After calculating the control amplification factor, the total number of genomes (or cells) in the sample can be determined.

In an embodiment, the number of total input genomes is determined by the following:

Number of total input genomes=$B_i/(B_{ii}/B_{iii})$=(Number of output sequencing products determined from the control gene segment amplicons)/(Control amplification factor)

The total number of input genomes is the total number of cells (adaptive immune cells and cells that are not adaptive immune cells) in the sample. Accordingly, the total number of cells in the sample can be determined.

V. Determining the relative representation of adaptive immune cells in the complex mixture of cells based on the absolute representation of adaptive immune cells in the sample and the absolute representation of total cells in the sample. The total number of adaptive immune cells is compared with the total number of cells. In an embodiment, the relative representation of adaptive immune cells is determined by dividing the total number of adaptive immune cells in the sample by the total number of cells in the sample.

In another embodiment, the total mass of DNA in the sample is used to quantify the total number of adaptive immune cells and non-adaptive immune cells in the complex mixture. Assuming that each cell has approximately 6.5 picograms of DNA and given a known total mass of input DNA to the PCR assay, the total number of total adaptive immune cells and non-adaptive immune cells in the sample is quantified by dividing the total known mass of input DNA by 6.5 picograms. This results in the relative representation of adaptive immune cells in the complex mixture of cells that include adaptive immune cells and cells that are not adaptive immune cells.

In other words, the relative representation of adaptive immune cells=total number of rearranged nucleic acid molecules encoding adaptive immune receptors/(total mass of DNA representing adaptive immune cells and non-adaptive immune cells).

Various other calculations as known to those of skill in the art can be used to determine the relative representation of adaptive immune cells in a complex mixture.

d. Methods for Determining a Ratio of T Cells or B Cells in a Sample Relative to the Total Number of Input Genomes Using Synthetic Templates and One or More Control Genes (Genomic Control Regions)

Methods of the invention include steps for determining a ratio of T cells or B cells in a sample relative to the total number of input genomes contained in said sample comprising:

A) amplifying by multiplex PCR and sequencing:
   i) rearranged CDR3 oligonucleotide sequences from T cell receptor (TCR) loci from T cells or Immunoglobulin (Ig) loci from B cells in said sample to obtain a total number of output biological sequences, each oligonucleotide sequence comprising a V segment and a J segment;
   ii) a first set of synthetic templates representing substantially all possible V segment and J segment combinations and each comprising one TCR or Ig V segment and one TCR or Ig J or C segment and a unique barcode which identifies said synthetic template as synthetic, and wherein each synthetic template comprises a unique combination of a V segment and J or C segment;

B) determining an amplification factor for each synthetic template comprising a unique combination of a V segment and a J or C segment, wherein said amplification factor is represented by a total number of first synthetic templates observed from step A(ii) divided by a total input number of unique first synthetic templates input in step A(ii);

C) determining the total number of T cells or B cells in the sample by dividing the total number of output biological sequences observed in step A(i) by the amplification factor from step B;

D) amplifying by multiplex PCR and sequencing:
   i) one or more genomic control regions from DNA obtained from said sample to obtain a total number of output biological sequences for each genomic control region; and
   ii) a second set of synthetic templates comprising the sequence of one or more of said genomic control sequences, a unique barcode and a stretch of random nucleic acids, wherein each synthetic template is represented only once;

E) determining an amplification factor for each of said genomic control region by dividing the total number of second synthetic templates amplified and sequenced in step D(ii) by the total input number of unique second synthetic templates amplified and sequenced in step D(ii);

F) determining the total number of input genomes by dividing the total number of output biological sequences for each genomic control region from step D(i) by the corresponding amplification factor for that genomic control region from Step E; and G) determining the ratio of T cells or B cells contained in the sample relative to the number of total genomes in the sample by dividing the total number of T cells or B cells obtained in step C by the total number of input genomes obtained in step F.

In some embodiments, the method comprises amplifying by multiplex PCR and sequencing two, three, four, five or more genomic control regions in step D(i). In certain embodiments, five genomic control regions are amplified and sequenced in step D(i).

In other embodiments, the total number of input genomes is calculated in step F by taking an average using each of the five amplification factors determined for each of said five genomic control regions. In another embodiment, the highest and lowest calculated number of input genomes is discarded prior to taking said average.

Examples of genomic control regions are PPIA, PSMB2, RAB7A, UBC, VCP, REEP5, and EMC7 or any other gene that has a known or predictable copy number (See SEQ ID NOs: 3160-3166 and 3241-3252 for a more comprehensive, albeit non-exhaustive list of genomic control regions.

In some embodiment, the total number of synthetic templates in said first set of synthetic templates subject to amplification in step A(ii) is determined using a limiting dilution of said synthetic templates each comprising a unique TCR or Ig V and J or C region such that each unique synthetic template is found in a single copy.

In other embodiments, the total number of synthetic templates in said first set of synthetic templates subject to amplification in step A(ii) is determined by counting the number of unique synthetic templates based on the unique random nucleotides contained in each synthetic template.

III. Methods for Diagnosing, Preventing, or Treating Disease in Patients Based on Determining Relative Representation of Adaptive Immune Cells in a Patient's Sample According to certain embodiments, methods are provided for determining a course of treatment for a patient in need thereof, comprising quantifying the relative representation of tumor-infiltrating lymphocytes or lymphocytes infiltrating a somatic tissue that is the target of an autoimmune reaction, using the methods described herein. In this regard, the patient in need thereof may be a cancer patient or a patient having an autoimmune disease. In certain embodiments, a patient may have a cancer including, but not limited to, colorectal, hepatocellular, gallbladder, pancreatic, esophageal, lung, breast, prostate, skin (e.g., melanoma), head and neck, renal cell carcinoma, ovarian, endometrial, cervical, bladder and urothelial cancer. In certain other embodiments, a patient may have an organ transplant, such as a liver transplant, a lung transplant, a kidney transplant, a heart transplant, a spleen transplant, a pancreas transplant, a skin transplant/graft, an intestine transplant, and a thymus transplant.

Autoimmune diseases include, but are not limited to, arthritis (including rheumatoid arthritis, reactive arthritis), systemic lupus erythematosus (SLE), psoriasis, inflammatory bowel disease (IBD) (including ulcerative colitis and Crohn's disease), encephalomyelitis, uveitis, myasthenia gravis, multiple sclerosis, insulin dependent diabetes, Addison's disease, celiac disease, chronic fatigue syndrome, autoimmune hepatitis, autoimmune alopecia, ankylosing spondylitis, fibromyalgia, pemphigus vulgaris, Sjogren's syndrome, Kawasaki's Disease, hyperthyroidism/Graves disease, hypothyroidism/Hashimoto's disease, endometriosis, scleroderma, pernicious anemia, Goodpasture syndrome, Guillain-Barré syndrome, Wegener's disease, glomerulonephritis, aplastic anemia (including multiply transfused aplastic anemia patients), paroxysmal nocturnal hemoglobinuria, idiopathic thrombocytopenic purpura, autoimmune hemolytic anemia, Evan's syndrome, Factor VIII inhibitor syndrome, systemic vasculitis, dermatomyositis, polymyositis and rheumatic fever, autoimmune lymphoproliferative syndrome (ALPS), autoimmune bullous pemphigoid, Parkinson's disease, sarcoidosis, vitiligo, primary biliary cirrhosis, and autoimmune myocarditis.

The methods described herein may be used to enumerate the relative presence of tumor-infiltrating lymphocytes, or of lymphocytes infiltrating a somatic tissue that is the target of an autoimmune reaction, based on quantification of the relative representation of DNA from such adaptive immune cells in DNA extracted from a biological sample, comprising a mixture of cell types, that has been obtained from such a tumor or tissue. Such methods are useful for determining cancer or autoimmune disease prognosis and diagnosis, for assessing effects of a therapeutic treatment (e.g., assessing drug efficacy and/or dose-response relationships), and for identifying therapeutic courses for cancer treatment, for treatment of autoimmune diseases, or for treatment of transplant rejection, and may find other related uses.

To assess a therapeutic treatment, for example, certain embodiments contemplate a method in which is assessed an effect of the therapeutic treatment on the relative representation of adaptive immune cells in at least one tissue in a subject to whom the treatment has been administered. By way of illustration and not limitation, according to certain such embodiments a treatment that alters (e.g., increases or decreases in a statistically significant manner) the relative representation of adaptive immune cells in a tissue or tissues may confer certain benefits on the subject. For instance, certain cancer immunotherapies are designed to enhance the number of tumor infiltrating lymphocytes (TIL). It has been shown that the presence of CD3+ TIL in ovarian tumors is strongly correlated with patient outcome (see, e.g., Hwang et al., 2011 *Gynecol. Oncol.,* 124(2):192). Further data clarified that in addition to TIL presence, the characteristics of the TIL populations were also significant: CD8+ TILs and clonal TILs were associated with longer Disease Free Survival (DFS), and infiltrating regulatory T cells were associated with shorter DFS (see, Stumpf et al., 2009 *Br. J. Cancer* 101:1513-21). These studies indicated that TIL may be an independent prognostic factor (see, Clarke et al., 2009 *Mod. Pathol.* 22:393-402). Thus, quantification of the relative representation of adaptive immune cell DNA as described herein, for purposes of detecting possible increases in TIL in tumor tissue samples obtained at one or a plurality of time points before treatment, during the course of treatment and/or following treatment may provide highly useful information with respect to determining efficacy of the treatment, and therefrom developing a prognosis for the subject.

As another example, certain autoimmune disease-directed immunotherapies are designed to reduce the number of tissue infiltrating lymphocytes in one or more afflicted tissues such as tissues or organs that may be targets of clinically inappropriate autoimmune attack, such that quantification of the relative representation of adaptive immune cell DNA as described herein, for purposes of detecting possible decreases in adaptive immune cells in tissue samples obtained at one or a plurality of time points before treatment, during the course of treatment and/or following treatment may provide highly useful information with respect to determining efficacy of the treatment, and therefrom developing a prognosis for the subject.

As a further example, certain transplant rejection-directed immunotherapies are designed to reduce the number of tissue infiltrating lymphocytes in transplanted organs, such that quantification of the relative representation of adaptive immune cell DNA as described herein, for purposes of detecting possible decreases in adaptive immune cells in tissue samples from transplanted organs obtained at one or a plurality of time points before treatment, during the course of treatment and/or following treatment may provide highly useful information with respect to determining efficacy of the treatment, and therefrom developing a prognosis for the subject.

In these and related embodiments, the herein described methods for quantifying the relative representation of adaptive immune cell DNA may be practiced using test biological samples obtained from a subject at one or a plurality of time points prior to administering the therapeutic treatment to the subject, and at one or a plurality of time points after administering the therapeutic treatment to the subject. The samples may be obtained from the same or from different tissues, which may vary as a function of the particular condition of the subject. For example, by way of illustration and not limitation, in the case of an inoperable tumor the test biological samples that are obtained from the subject before and after treatment may be from the same tissue, whereas in the case of a tumor that is partially removed surgically, or that occurs at multiple sites in the subject, the test biological samples may be obtained from different tissues or from different tissue sites before and after the therapeutic treatment is administered.

Also contemplated herein are embodiments in which any of the herein described methods may further comprise determination of the relative structural diversity of adaptive immune receptors (e.g., the sequence diversity among products of productively rearranged TCR and/or immunoglobulin genes) in the adaptive immune cell component of the mixture of cells that is present in the test biological sample. In certain such embodiments, the present qPCR methodologies using the herein described rearranged adaptive immune receptor encoding specific oligonucleotide primer sets permit ready identification of the particular primer combinations that generate the production of amplified rearranged DNA molecules. Accordingly, for example, these embodiments permit determination of the relative degree of clonality of an adaptive immune cell population that is present as part of a mixed cell population in a test biological sample, which may have prognostic value.

For instance, in a solid tumor sample in which TILs are detected by quantifying the relative representation of adaptive immune cell DNA in DNA extracted from the sample as described herein, the present methods contemplate determination of whether only one or a few (e.g., no more than 1, 2, 3, 4, 5, 6, 7, 8, 9 or 10) combinations of a particular V-segment oligonucleotide primer and a particular J-segment oligonucleotide primer are predominantly (e.g., generating at least 80, 85, 90, 95, 97 or 99 percent of amplification products) responsible for the PCR production of amplified rearranged adaptive immune cell DNA molecules. Such an observation of one or a few predominant adaptive immune receptor gene-encoding amplification product would, according to non-limiting theory, indicate a low degree of TIL heterogeneity. Conversely, determination of a high degree of heterogeneity in adaptive immune receptor structural diversity by characterization of TIL DNA would indicate that a predominant TIL clone is not present.

Accordingly, described herein are methods for measuring the number of adaptive immune cells (e.g. T cells) in a complex mixture of cells. The present methods have particular utility in quantifying tumor-infiltrating lymphocytes or lymphocytes infiltrating somatic tissue that is the target of an autoimmune response. Existing methods for T and B cell quantification rely upon the physical separation of such cells from the mixture. However, in many cases, T and B cells cannot be separated from the initial sample, such as formalin-fixed or frozen tissue samples. Furthermore, prior methods for adaptive immune cell quantification (e.g., flow immunocytofluorimetry, fluorescence activated cell sorting (FACS), immunohistochemistry (IHC)) rely on the expression of T cell- or B cell-specific proteins, such as cell surface receptors. Since immune cells express varying amounts of these lineage specific receptors, quantifying the number of cells from such a highly variable measure requires costly standardization, specialized equipment and highly trained staff. The presently disclosed methods are, by contrast, platform-independent and can be performed on any PCR instrument and high-throughput sequencing instrument, and the reagents can be synthesized and provided in kit form. The presently disclosed methods are also highly sensitive and can be applied in high throughput settings not previously attainable. As described herein, quantification of adaptive immune cells may be achieved by a simple preparation of DNA from a complex mixture of cells, in concert with quantification of the relative proportion of adaptive immune cells present by amplification of the rearranged adaptive immune cell CDR3-encoding genes.

In certain embodiments, the invention includes methods for comparing adaptive immune cell DNA quantities with total cell DNA (e.g., from adaptive immune cells plus non-adaptive immune cells in the cell mixture). Methods also include optionally comparing other relevant parameters before, during or after administration to a control subject of control compositions that can be, for example, negative controls that have been previously demonstrated to have undergone no statistically significant alteration of physiological state, such as sham injection, saline, DMSO or other vehicle or buffer control, inactive enantiomers, scrambled peptides or nucleotides, etc., and/or before, during or after administration of positive controls that have been previously demonstrated to cause a statistically significant alteration of physiological state, such as an FDA-approved therapeutic compound.

The practice of certain embodiments of the present invention will employ, unless indicated specifically to the contrary, conventional methods in microbiology, molecular biology, biochemistry, molecular genetics, cell biology, virology and immunology techniques that are within the skill of the art, and reference to several of which is made below for the purpose of illustration. Such techniques are explained fully in the literature. See, e.g., Sambrook, et al., *Molecular Cloning: A Laboratory Manual* ($3^{rd}$ Edition, 2001); Sambrook, et al., *Molecular Cloning: A Laboratory Manual* ($2^{nd}$ Edition, 1989); Maniatis et al., *Molecular Cloning: A Laboratory Manual* (1982); Ausubel et al., *Current Protocols in Molecular Biology* (John Wiley and Sons, updated July 2008); *Short Protocols in Molecular Biology: A Compendium of Methods from Current Protocols in Molecular Biology*, Greene Pub. Associates and Wiley-Interscience; Glover, *DNA Cloning: A Practical Approach*, vol. I & II (IRL Press, Oxford Univ. Press USA, 1985); *Current Protocols in Immunology* (Edited by: John E. Coligan, Ada M. Kruisbeek, David H. Margulies, Ethan M. Shevach, Warren Strober 2001 John Wiley & Sons, NY, N.Y.); *Real-Time PCR: Current Technology and Applications*, Edited by Julie Logan, Kirstin Edwards and Nick Saunders, 2009, Caister Academic Press, Norfolk, UK; Anand, *Techniques for the Analysis of Complex Genomes*, (Academic Press, New York, 1992); Guthrie and Fink, *Guide to Yeast Genetics and Molecular Biology* (Academic Press, New York, 1991); Oligonucleotide Synthesis (N. Gait, Ed., 1984); *Nucleic Acid Hybridization* (B. Hames & S. Higgins, Eds., 1985); *Transcription and Translation* (B. Hames & S. Higgins, Eds., 1984); *Animal Cell Culture* (R. Freshney, Ed., 1986); Perbal, *A Practical Guide to Molecular Cloning* (1984); *Next-Generation Genome Sequencing* (Janitz, 2008 Wiley-VCH); *PCR Protocols (Methods in Molecular Biology)* (Park, Ed., $3^{rd}$ Edition, 2010 Humana Press); *Immobilized Cells And Enzymes* (IRL Press, 1986); the treatise, *Methods In Enzymology* (Academic Press, Inc., N.Y.); *Gene Transfer Vectors For Mammalian Cells* (J. H. Miller and M. P. Calos eds., 1987, Cold Spring Harbor Laboratory); Harlow and Lane, *Antibodies*, (Cold Spring Harbor Laboratory Press, Cold Spring Harbor, N.Y., 1998); *Immunochemical Methods In Cell And Molecular Biology* (Mayer and Walker, eds., Academic Press, London, 1987); *Handbook Of Experimental Immunology*, Volumes I-IV (D. M. Weir and C C Blackwell, eds., 1986); Riott, *Essential*

*Immunology,* 6th Edition, (Blackwell Scientific Publications, Oxford, 1988); *Embryonic Stem Cells: Methods and Protocols* (Methods in Molecular Biology) (Kurstad Turksen, Ed., 2002); *Embryonic Stem Cell Protocols: Volume I: Isolation and Characterization* (Methods in Molecular Biology) (Kurstad Turksen, Ed., 2006); *Embryonic Stem Cell Protocols: Volume II: Differentiation Models* (Methods in Molecular Biology) (Kurstad Turksen, Ed., 2006); *Human Embryonic Stem Cell Protocols* (Methods in Molecular Biology) (Kursad Turksen Ed., 2006); *Mesenchymal Stem Cells: Methods and Protocols* (Methods in Molecular Biology) (Darwin J. Prockop, Donald G Phinney, and Bruce A. Bunnell Eds., 2008); *Hematopoietic Stem Cell Protocols* (Methods in Molecular Medicine) (Christopher A. Klug, and Craig T. Jordan Eds., 2001); *Hematopoietic Stem Cell Protocols* (Methods in Molecular Biology) (Kevin D. Bunting Ed., 2008) *Neural Stem Cells: Methods and Protocols* (Methods in Molecular Biology) (Leslie P. Weiner Ed., 2008).

Unless specific definitions are provided, the nomenclature utilized in connection with, and the laboratory procedures and techniques of, molecular biology, analytical chemistry, synthetic organic chemistry, and medicinal and pharmaceutical chemistry described herein are those well known and commonly used in the art. Standard techniques may be used for recombinant technology, molecular biological, microbiological, chemical syntheses, chemical analyses, pharmaceutical preparation, formulation, and delivery, and treatment of patients.

Unless the context requires otherwise, throughout the present specification and claims, the word "comprise" and variations thereof, such as, "comprises" and "comprising" are to be construed in an open, inclusive sense, that is, as "including, but not limited to". By "consisting of" is meant including, and typically limited to, whatever follows the phrase "consisting of." By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that no other elements are required and may or may not be present depending upon whether or not they affect the activity or action of the listed elements.

In this specification and the appended claims, the singular forms "a," "an" and "the" include plural references unless the content clearly dictates otherwise. As used herein, in particular embodiments, the terms "about" or "approximately" when preceding a numerical value indicates the value plus or minus a range of 5%, 6%, 7%, 8% or 9%. In other embodiments, the terms "about" or "approximately" when preceding a numerical value indicates the value plus or minus a range of 10%, 11%, 12%, 13% or 14%. In yet other embodiments, the terms "about" or "approximately" when preceding a numerical value indicates the value plus or minus a range of 15%, 16%, 17%, 18%, 19% or 20%.

Reference throughout this specification to "one embodiment" or "an embodiment" or "an aspect" means that a particular feature, structure or characteristic described in connection with the embodiment is included in at least one embodiment of the present invention. Thus, the appearances of the phrases "in one embodiment" or "in an embodiment" in various places throughout this specification are not necessarily all referring to the same embodiment. Furthermore, the particular features, structures, or characteristics may be combined in any suitable manner in one or more embodiments.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

Example 1: Constructing Synthetic Templates and Estimating the Number of Input Synthetic Templates Synthetic templates were designed and constructed as shown in FIGS. 1A and 1B. Each synthetic template included a 495 bp sequence comprising a universal primer sequence (UA) (102), a 16 bp template-specific barcode (BC) (104), a 300 bp adaptive immune receptor variable (V) region encoding gene sequence (V gene) (106), a 9 bp synthetic template internal marker (IM) (108), a repeat of the barcode (BC) (104), a repeat of the internal marker (IM) (108), a 100 bp adaptive immune receptor variable (J) region encoding gene sequence (J gene) (110), a third repeat of the barcode (BC) (104), and a reverse universal primer sequence (UB) (112). Synthetic templates can also be designed as described in Carlson, C. S. et al. Using synthetic templates to design an unbiased multiplex PCR assay. *Nature Communications* 4, 2680, doi: 10.1038/ncomms3680 (2013). Synthetic templates were constructed that included substantially all V-segment and J-segment combinations of rearranged adaptive immune receptors. Sequences of the synthetic templates are found in Table A.

The starting pool of synthetic templates was quantified using simplex PCR. Universal primers specific for the universal primer regions (102) and (112) and tailed with Illumina adaptor regions were used to amplify and sequence the synthetic templates. To estimate the number of sequencing reads of the synthetic template amplicons generated per input synthetic template, the number of input synthetic templates added to the PCR was estimated using a limiting dilution. A limiting dilution was achieved by diluting the amount of DNA in each sample to the point where only a very small amount of mixed synthetic template oligonucleotides was present in the dilution (e.g., a small subset of unique synthetic template oligonucleotides at a low copy per template). When a limiting dilution of synthetic template oligonucleotides was added to the PCR assay, the majority of unique synthetic template oligonucleotides was not detected by PCR in the sample, and the synthetic template oligonucleotides that were detected were likely to have been added as a single copy. Thus, the simplex PCR results accurately characterized the concentration of each unique synthetic template in the sample.

FIG. 2 is a graph showing the relationship between the number of unique synthetic templates in the sample and the total number of synthetic templates in the sample. This relationship was analyzed using an in silico simulation of a random sampling from the pool of synthetic templates. The mean and standard deviation of the number of unique synthetic templates observed (y-axis) are presented as a function of the total number of molecules sampled from the synthetic template oligonucleotide pool (x-axis). The graph demonstrates that the detected number of unique synthetic template oligonucleotides provides information regarding the total number of molecules in the pool. Aliquots of this pool of synthetic templates can be spiked in to subsequent multiplex PCRs (in the Examples below, for instance) and used to determine a number of input molecules in a particular sample.

Example 2: Validating Method of Estimating the Number of Input Synthetic Templates To validate the method described in Example 1 of estimating the number of input synthetic templates added to the PCR, bulk fibroblast gDNA and gDNA from sorted (CD19+) B cells were used to construct mixtures of 300 ng total gDNA, containing various combinations of B cell DNA (from 0.07 ng to 300 ng) and fibroblast DNA. Since each sample contained a known proportion of input B cell DNA, the number of rearranged IgH loci in each sample was also known. This number was compared to the number of rearranged IgH input synthetic templates estimated using the method described in Example 1. Examples of rearranged IgH input synthetic template sequences are found in SEQ ID NOs: 1645-3003.

Figure 3:
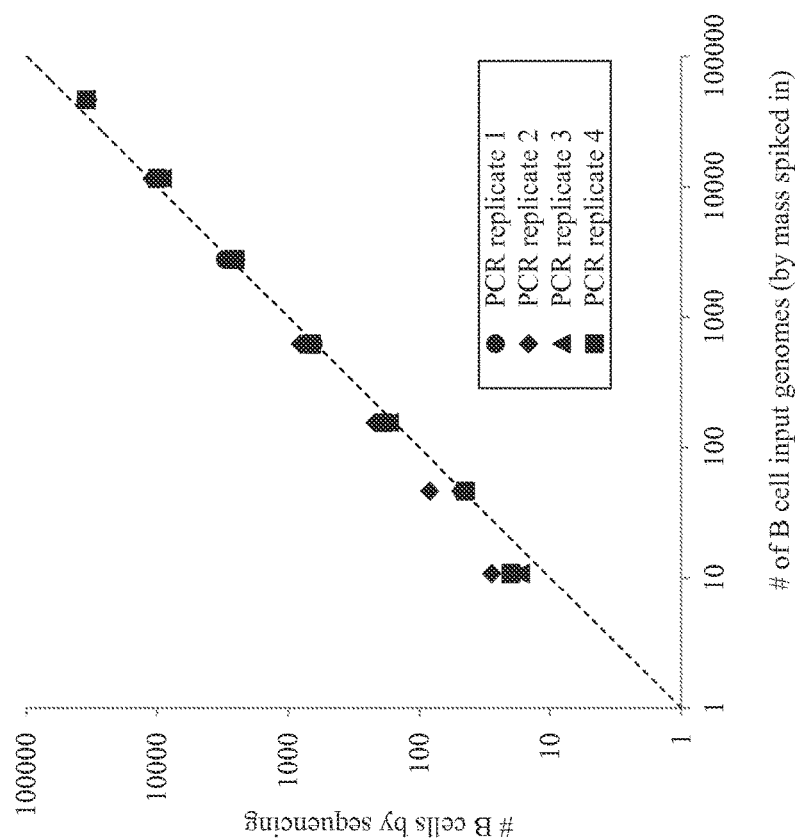
FIG. 3 is a graph comparing a known number of B cell genomes in a sample with the estimated number of B cell genomes in the sample using synthetic template oligonucleotides, according to one embodiment of the invention.

This validation experiment was replicated four times using four separate PCRs and sequencing reactions. The graph in FIG. 3 shows that the four PCRs exhibited replicable results, and that the Example 1 method of estimating the number of input synthetic templates was successful, since the estimated numbers were in agreement with the known numbers of rearranged IgH loci.

Example 3: Determining a Relative Representation of T Cells in a Mixture of Cells To determine the relative representation of tumor-infiltrating lymphocytes (TILs) in four tissue samples taken from high-grade serous ovarian carcinomas, TCRB ddPCR was performed (as described in U.S. application Ser. No. 13/656,265; and Robins, H. S. et al. Digital genomic quantification of tumor-infiltrating lymphocytes. *Science Translational Medicine* 5, 214ra169, doi:10.1126/scitranslmed.3007247 (2013), hereby incorporated by reference). Furthermore, synthetic templates were used to separately determine the relative representation of TILs. First, a sample was prepared that included both gDNA extracted from the tumor tissue and synthetic templates as shown in FIG. 1 including substantially all V-segment and J-segment combinations of rearranged adaptive immune receptors (synthetic template sequences are found in SEQ ID NOs: 787-1644). Next, a multiplex PCR was performed on the sample using V-segment and J-segment primers to amplify nucleic acid molecules comprising i) rearranged TCR or Ig adaptive immune receptor nucleic acid molecules, each comprising a V region and a J region, and ii) synthetic template oligonucleotides having a known input amount, thereby generating amplicons comprising a plurality of rearranged TCR or Ig adaptive immune receptor amplicons and a plurality of synthetic template amplicons.

The amplicons were sequenced to determine the number of rearranged TCR or Ig adaptive immune receptor amplicons and the number of unique synthetic template amplicons. The amplification factor was determined by calculating the ratio of the number of output sequencing products from the synthetic template amplicons with the known number of input synthetic template oligonucleotides, determined using the estimation method of Example 1 and described herein.

Next, the absolute number of input rearranged TCR or Ig adaptive immune receptor molecules in the sample was determined by dividing the number of output sequencing products determined from the rearranged TCR or Ig adaptive immune receptor amplicons by the amplification factor. The absolute number of input rearranged TCR or Ig receptor molecules equates to the total number adaptive immune cells in the sample.

From there, the number of total adaptive immune cells and non-adaptive immune cells in the sample was determined by dividing a total known mass of input DNA by 6.5 picograms (assuming that each cell has approximately 6.5 picograms of DNA and given a known total mass of input DNA to the PCR assay). The relative representation of adaptive immune cells in the sample was calculated by dividing the number of unique adaptive immune cells by the total number of adaptive immune cells and non-adaptive immune cells in the sample.

Figure 4:
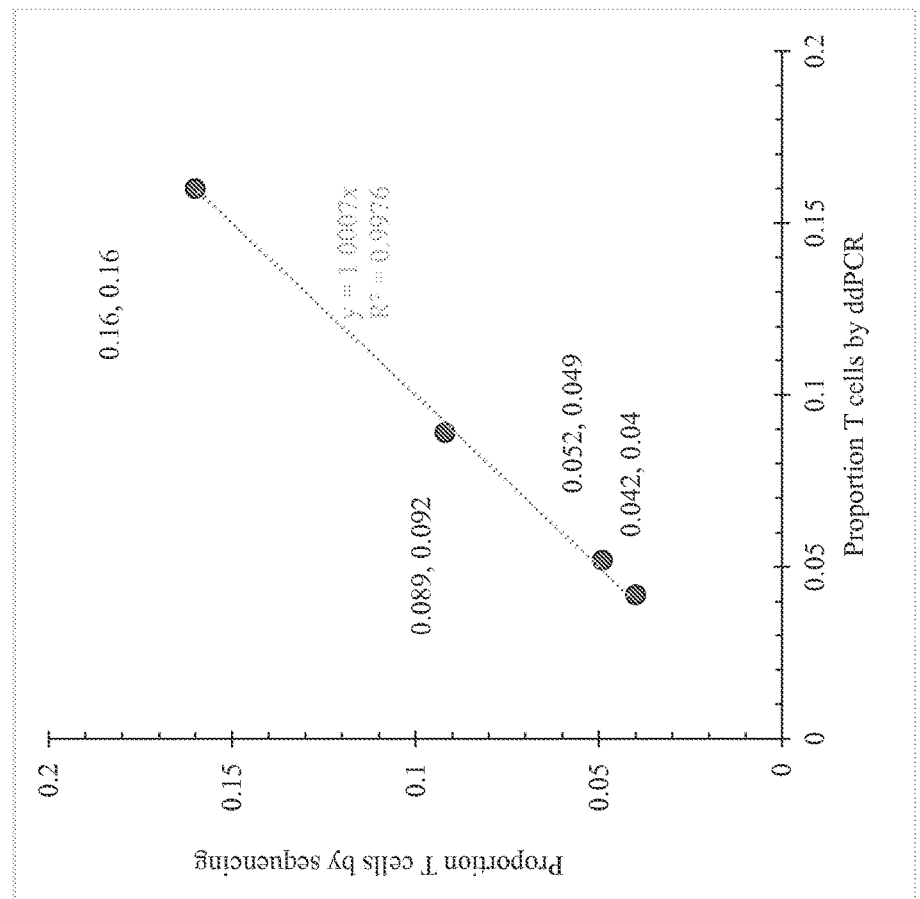
FIG. 4 is a graph showing calculations of relative representations of T cells out of total cells in a sample, either via ddPCR methods or using synthetic template oligonucleotides, according to one embodiment of the invention.
Figure 5:
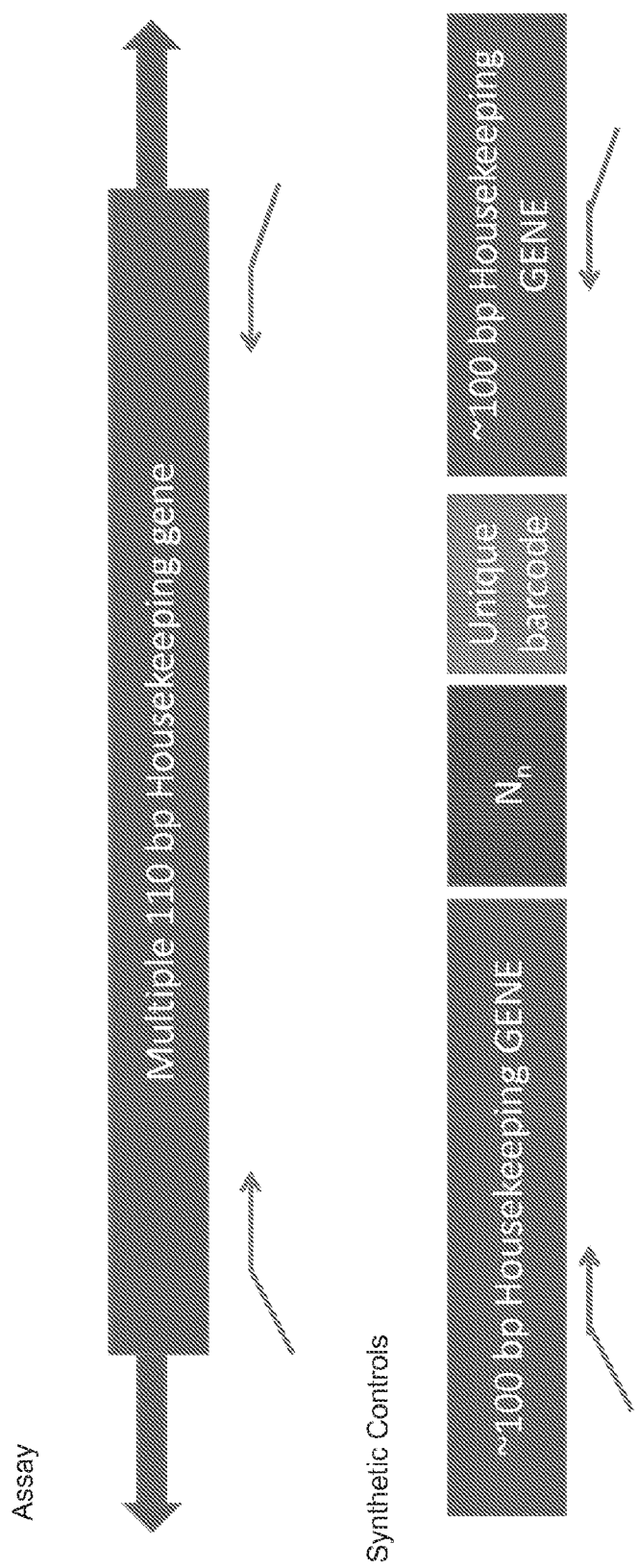
FIG. 5 illustrates an example of a control synthetic template oligonucleotide and its relationship to a representative genomic locus, according to one embodiment of the invention, and the relationship of the control synthetic template oligonucleotide to the genomic locus it represents.

FIG. 4 is a graph showing (1) the relative representation of T cells in the sample determined using ddPCR methods, as described in U.S. application Ser. No. 13/656,265, filed on Oct. 21, 2012, and International App. No. PCT/US2012/061193, filed on Oct. 21, 2012, each of which is incorporated by reference in its entirety, as compared with (2) the relative representation of T cells in the sample using synthetic templates and the methods described above. FIG. 4 shows that similar numbers are calculated using both methods. Therefore, synthetic templates can be used to accurately calculate the relative representation of adaptive immune cells in a sample containing adaptive immune cells and non-adaptive immune cells.

Example 4: Determining a Relative Representation of T Cells in a Mixture of Cells Using Genomic Control Regions In this example, synthetic templates and genomic control genes were used to accurately calculate the relative representation of adaptive immune cells in a sample containing adaptive immune cells and non-adaptive immune cells.

Sample Source:

T cells were isolated from whole blood using standard cell biology techniques. DNA was extracted from the population of purified T cells. DNA was normalized, assuming 6.4 pg DNA/double stranded human genome such that approximately 5 genomes, 250 genomes, 1250 genomes, or 6250 genomes of T cell DNA were added to a standard TCRB PCR reaction.

Multiplex PCR Reaction:

TCRB Assay: Rearranged TCRB genes were amplified using a multiplex PCR. V segment and J segment primers were designed to amplify ~110 bp rearranged fragments. Synthetic templates were added to each PCR reaction and were amplified with the same primers, and the synthetic templates included a barcode to differentiate them from biologic templates. The volume of DNA necessary to add 5, 250, 1250, and 6250 genomes were added to each PCR reaction.

A second PCR tailing reaction was performed using tailing primers comprising well-specific barcodes and Illumina sequencing adaptors. The PCR tailing reaction added well-specific barcodes and Illumina sequencing adaptors to each PCR product.

Genomic Control Assay:

In addition to the TCRB assay, five single copy autosomal loci were amplified using a multiplex PCR assay. Each single copy autosomal locus is present in every cell and serves as a genomic control. The genomic controls were used to count the number of genomes present in the sample.

Primers were designed to amplify 110 bp fragments of each locus, which were the same size as the TCRB primers.

The multiplex PCR reaction included co-amplification of synthetic templates that include oligonucleotide sequences of each of the five autosomal genes. The synthetic templates included unique barcodes that identify the molecules as synthetic templates and a 6 bp random sequence. The same concentration of DNA for genomic controls was used as the TCRB genes, but at an eighth of the volume, such that less than 1 genome, 31, 156, 781 double stranded genomes were added to each PCR reaction. Well specific barcodes and illumina sequencing adaptors were added to each PCR product in a second tailing PCR assay, as described above.

Sequencing:

Samples were pooled, normalized, and loaded on an Illumina MiSEQ. Output sequence data was processed, and sequence reads of the synthetic templates were used to measure sequencing coverage. Sequencing coverage is an estimate of the number of sequencing clusters derived from a single molecule added to the PCR reaction.

Figure 6:
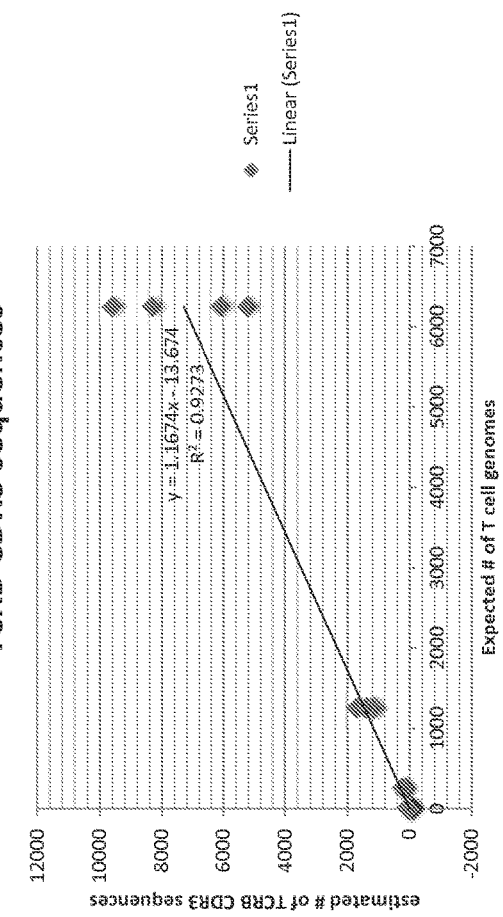
FIG. 6 illustrates that the methods of the current invention utilizing genomic control regions are able to accurately calculate the number of input genomes and number of T cells based on the number of input sequences.
Figure 6:
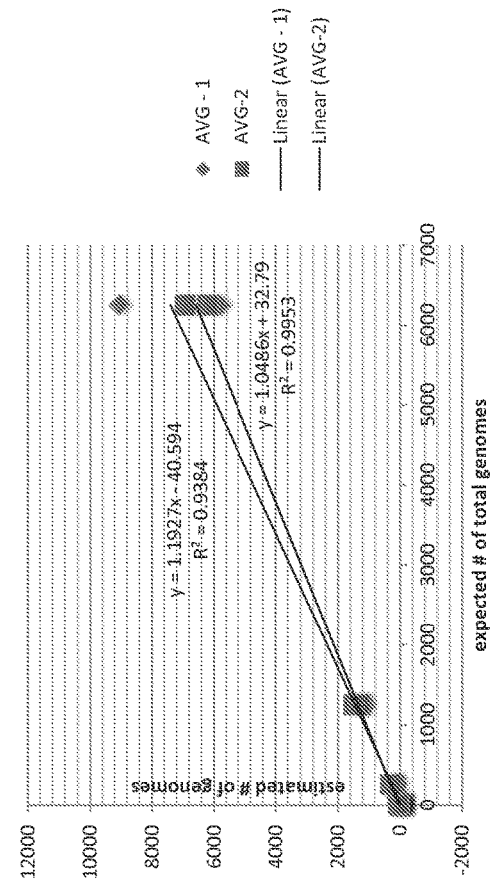

Analysis:

The number of TCRB molecules in the sample was estimated using the methods described above. The number of genomes added to the TCRB assay was determined by estimating the number of genomes in the genomic control assay as previously described (Section III). The calculated number of genomes from the genomic control assay was scaled by 4 to account for 1) that there were 2 loci/genome and 2) the eight fold reduction of input (FIG. 6).

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

---

SEQUENCE LISTING (3252 sequences)

SEQ ID NO: 1 - DNA, 26 bp, Artificial Sequence
  TCRB V-Segment Forward Primer
gaatgccctgacagctctcgcttata

SEQ ID NO: 2 - DNA, 41 bp, Artificial Sequence
  TCRB V-Segment Forward Primer
ctcagagaagtctgaaatattcgatgatcaattctcagttg

SEQ ID NO: 3 - DNA, 34 bp, Artificial Sequence
  TCRB V-Segment Forward Primer
ccaaatcgmttctcacctaaatctccagacaaag

SEQ ID NO: 4 - DNA, 26 bp, Artificial Sequence
  TCRB V-Segment Forward Primer
cacctgactctccagacaaagctcat

SEQ ID NO: 5 - DNA, 22 bp, Artificial Sequence
  TCRB V-Segment Forward Primer
cctgaatgccccaacagctctc

SEQ ID NO: 6 - DNA, 24 bp, Artificial Sequence
  TCRB V-Segment Forward Primer
gattctcagggcgccagttctcta

SEQ ID NO: 7 - DNA, 31 bp, Artificial Sequence
  TCRB V-Segment Forward Primer
cctaattgattctcagctcaccacgtccata

SEQ ID NO: 8 - DNA, 19 bp, Artificial Sequence
  TCRB V-Segment Forward Primer
tcagggcgccagttccatg

SEQ ID NO: 9 - DNA, 29 bp, Artificial Sequence
  TCRB V-Segment Forward Primer
tcctagattctcaggtctccagttcccta

SEQ ID NO: 10 - DNA, 28 bp, Artificial Sequence
  TCRB V-Segment Forward Primer
gaggaaacttccctgatcgattctcagc

SEQ ID NO: 11 - DNA, 27 bp, Artificial Sequence
  TCRB V-Segment Forward Primer
caacttccctgatcgattctcaggtca

SEQ ID NO: 12 - DNA, 30 bp, Artificial Sequence
  TCRB V-Segment Forward Primer
aggaaacttccctgatcaattctcaggtca

SEQ ID NO: 13 - DNA, 29 bp, Artificial Sequence
  TCRB V-Segment Forward Primer
ggaaacttccctcctagattttcaggtcg

SEQ ID NO: 14 - DNA, 27 bp, Artificial Sequence
  TCRB V-Segment Forward Primer
ccccaatggctacaatgtctccagatt

SEQ ID NO: 15 - DNA, 23 bp, Artificial Sequence
  TCRB V-Segment Forward Primer
ggagaggtccctgatggctacaa

SEQ ID NO: 16 - DNA, 28 bp, Artificial Sequence
  TCRB V-Segment Forward Primer
tccctgatggttatagtgtctccagagc

SEQ ID NO: 17 - DNA, 27 bp, Artificial Sequence
  TCRB V-Segment Forward Primer
ggagaagtccccaatggctacaatgtc

SEQ ID NO: 18 - DNA, 26 bp, Artificial Sequence
  TCRB V-Segment Forward Primer
aaaggagaagtcccgaatggctacaa

SEQ ID NO: 19 - DNA, 29 bp, Artificial Sequence
  TCRB V-Segment Forward Primer
gttcccaatggctacaatgtctccagatc

SEQ ID NO: 20 - DNA, 32 bp, Artificial Sequence
  TCRB V-Segment Forward Primer
gaagtccccaatggctacaatgtctctagatt

SEQ ID NO: 21 - DNA, 26 bp, Artificial Sequence
  TCRB V-Segment Forward Primer
gagaagtccccgatggctacaatgta

SEQ ID NO: 22 - DNA, 24 bp, Artificial Sequence
  TCRB V-Segment Forward Primer
gtgatcggttctctgcacagaggt

SEQ ID NO: 23 - DNA, 23 bp, Artificial Sequence
  TCRB V-Segment Forward Primer
cgcttctctgcagagaggactgg

SEQ ID NO: 24 - DNA, 22 bp, Artificial Sequence
  TCRB V-Segment Forward Primer
ggttctttgcagtcaggcctga

SEQ ID NO: 25 - DNA, 22 bp, Artificial Sequence
  TCRB V-Segment Forward Primer
cagtggtcggttctctgcagag

SEQ ID NO: 26 - DNA, 29 bp, Artificial Sequence
  TCRB V-Segment Forward Primer
gctcagtgatcaattctccacagagaggt

SEQ ID NO: 27 - DNA, 22 bp, Artificial Sequence
  TCRB V-Segment Forward Primer
ttctctgcagagaggcctgagg

SEQ ID NO: 28 - DNA, 25 bp, Artificial Sequence
  TCRB V-Segment Forward Primer
cccagtgatcgcttctttgcagaaa

SEQ ID NO: 29 - DNA, 23 bp, Artificial Sequence
  TCRB V-Segment Forward Primer
ctgcagagaggcctaagggatct

SEQ ID NO: 30 - DNA, 33 bp, Artificial Sequence
  TCRB V-Segment Forward Primer
gaagggtacaatgtctctggaaacaaactcaag

SEQ ID NO: 31 - DNA, 31 bp, Artificial Sequence
  TCRB V-Segment Forward Primer
ggggtactgtgtttcttgaaacaagcttgag

SEQ ID NO: 32 - DNA, 30 bp, Artificial Sequence
  TCRB V-Segment Forward Primer
cagttccctgacttgcactctgaactaaac

SEQ ID NO: 33 - DNA, 32 bp, Artificial Sequence
  TCRB V-Segment Forward Primer
actaacaaaggagaagtctcagatggctacag

SEQ ID NO: 34 - DNA, 27 bp, Artificial Sequence
  TCRB V-Segment Forward Primer
agataaaggagaagtccccgatggcta

SEQ ID NO: 35 - DNA, 35 bp, Artificial Sequence
  TCRB V-Segment Forward Primer
gatactgacaaaggagaagtctcagatggctatag

SEQ ID NO: 36 - DNA, 29 bp, Artificial Sequence
  TCRB V-Segment Forward Primer
ctaaggatcgattttctgcagagaggctc

SEQ ID NO: 37 - DNA, 27 bp, Artificial Sequence
  TCRB V-Segment Forward Primer
ttgattctcagcacagatgcctgatgt

SEQ ID NO: 38 - DNA, 24 bp, Artificial Sequence
  TCRB V-Segment Forward Primer
attctcagctgagaggcctgatgg

SEQ ID NO: 39 - DNA, 30 bp, Artificial Sequence
  TCRB V-Segment Forward Primer
ggatcgattctcagctaagatgcctaatgc

SEQ ID NO: 40 - DNA, 28 bp, Artificial Sequence
  TCRB V-Segment Forward Primer
ctcagcagagatgcctgatgcaacttta

SEQ ID NO: 41 - DNA, 29 bp, Artificial Sequence
  TCRB V-Segment Forward Primer
ctgatcgattctcagctcaacagttcagt

SEQ ID NO: 42 - DNA, 26 bp, Artificial Sequence
  TCRB V-Segment Forward Primer
tagctgaaaggactggagggacgtat

SEQ ID NO: 43 - DNA, 24 bp, Artificial Sequence
  TCRB V-Segment Forward Primer
ccaggaggccgaacacttctttct

SEQ ID NO: 44 - DNA, 25 bp, Artificial Sequence
  TCRB V-Segment Forward Primer
gctaagtgcctcccaaattcaccct

SEQ ID NO: 45 - DNA, 26 bp, Artificial Sequence
  TCRB V-Segment Forward Primer
cacagctgaaagacctaacggaacgt

SEQ ID NO: 46 - DNA, 24 bp, Artificial Sequence
  TCRB V-Segment Forward Primer
ctgctgaatttcccaaagagggcc

SEQ ID NO: 47 - DNA, 20 bp, Artificial Sequence
  TCRB V-Segment Forward Primer
agggtacagcgtctctcggg

SEQ ID NO: 48 - DNA, 23 bp, Artificial Sequence
  TCRB V-Segment Forward Primer
gcctgaccttgtccactctgaca

SEQ ID NO: 49 - DNA, 27 bp, Artificial Sequence
  TCRB V-Segment Forward Primer
atgagcgatttttagcccaatgctcca

SEQ ID NO: 50 - DNA, 24 bp, Artificial Sequence
  TCRB V-Segment Forward Primer
tgaaggctacgtgtctgccaagag

SEQ ID NO: 51 - DNA, 24 bp, Artificial Sequence
  TCRB V-Segment Forward Primer
ctcatctcaatgccccaagaacgc

SEQ ID NO: 52 - DNA, 31 bp, Artificial Sequence
  TCRB V-Segment Forward Primer
agatctctgatggatacagtgtctctcgaca

SEQ ID NO: 53 - DNA, 34 bp, Artificial Sequence
  TCRB V-Segment Forward Primer
agatctttcctctgagtcaacagtctccagaata

SEQ ID NO: 54 - DNA, 35 bp, Artificial Sequence
  TCRB V-Segment Forward Primer
cactgaaaaaggagatatctctgaggggtatcatg

SEQ ID NO: 55 - DNA, 31 bp, Artificial Sequence
  TCRB V-Segment Forward Primer
gttcctgaagggtacaaagtctctcgaaaag

SEQ ID NO: 56 - DNA, 27 bp, Artificial Sequence
  TCRB V-Segment Forward Primer
ctgaggggtacagtgtctctagagaga

SEQ ID NO: 57 - DNA, 25 bp, Artificial Sequence
  TCRB V-Segment Forward Primer
agccgcccaaacctaacattctcaa

SEQ ID NO: 58 - DNA, 18 bp, Artificial Sequence
  TCRB V-Segment Forward Primer
cccaggaccggcagttca

SEQ ID NO: 59 - DNA, 40 bp, Artificial Sequence
  TCRB V-Segment Forward Primer
ttgattagagacatatccctattgaaaatatttcctggca

SEQ ID NO: 60 - DNA, 31 bp, Artificial Sequence
  TCRB V-Segment Forward Primer
agatgccctgagtcagcatagtcattctaac

SEQ ID NO: 61 - DNA, 49 bp, Artificial Sequence
  TCRB V-Segment Forward Primer With Universal Adaptor Sequence
gggctggcaagccacgtttggtggaatgccctgacagctctcgcttata

SEQ ID NO: 62 - DNA, 64 bp, Artificial Sequence
  TCRB V-Segment Forward Primer With Universal Adaptor Sequence
gggctggcaagccacgtttggtgctcagagaagtctgaaatattcgatgatcaattctcagttg

SEQ ID NO: 63 - DNA, 57 bp, Artificial Sequence
  TCRB V-Segment Forward Primer With Universal Adaptor Sequence
gggctggcaagccacgtttggtgccaaatcgmttctcacctaaatctccagacaaag

SEQ ID NO: 64 - DNA, 49 bp, Artificial Sequence
  TCRB V-Segment Forward Primer With Universal Adaptor Sequence
gggctggcaagccacgtttggtgcacctgactctccagacaaagctcat

SEQ ID NO: 65 - DNA, 45 bp, Artificial Sequence
  TCRB V-Segment Forward Primer With Universal Adaptor Sequence
gggctggcaagccacgtttggtgcctgaatgccccaacagctctc

SEQ ID NO: 66 - DNA, 47 bp, Artificial Sequence
  TCRB V-Segment Forward Primer With Universal Adaptor Sequence
gggctggcaagccacgtttggtggattctcagggcgccagttctcta

SEQ ID NO: 67 - DNA, 54 bp, Artificial Sequence
  TCRB V-Segment Forward Primer With Universal Adaptor Sequence
gggctggcaagccacgtttggtgcctaattgattctcagctcaccacgtccata

SEQ ID NO: 68 - DNA, 42 bp, Artificial Sequence
  TCRB V-Segment Forward Primer With Universal Adaptor Sequence
gggctggcaagccacgtttggtgtcagggcgccagttccatg

SEQ ID NO: 69 - DNA, 52 bp, Artificial Sequence
  TCRB V-Segment Forward Primer With Universal Adaptor Sequence
gggctggcaagccacgtttggtgtcctagattctcaggtctccagttcccta

SEQ ID NO: 70 - DNA, 51 bp, Artificial Sequence
  TCRB V-Segment Forward Primer With Universal Adaptor Sequence
gggctggcaagccacgtttggtggaggaaacttccctgatcgattctcagc

SEQ ID NO: 71 - DNA, 50 bp, Artificial Sequence
  TCRB V-Segment Forward Primer With Universal Adaptor Sequence
gggctggcaagccacgtttggtgcaacttccctgatcgattctcaggtca

SEQ ID NO: 72 - DNA, 53 bp, Artificial Sequence
  TCRB V-Segment Forward Primer With Universal Adaptor Sequence
gggctggcaagccacgtttggtgaggaaacttccctgatcaattctcaggtca

SEQ ID NO: 73 - DNA, 52 bp, Artificial Sequence
  TCRB V-Segment Forward Primer With Universal Adaptor Sequence
gggctggcaagccacgtttggtgggaaacttccctcctagattttcaggtcg

SEQ ID NO: 74 - DNA, 50 bp, Artificial Sequence
  TCRB V-Segment Forward Primer With Universal Adaptor Sequence
gggctggcaagccacgtttggtgccccaatggctacaatgtctccagatt

SEQ ID NO: 75 - DNA, 46 bp, Artificial Sequence
  TCRB V-Segment Forward Primer With Universal Adaptor Sequence
gggctggcaagccacgtttggtgggagaggtccctgatggctacaa

SEQ ID NO: 76 - DNA, 51 bp, Artificial Sequence
  TCRB V-Segment Forward Primer With Universal Adaptor Sequence
gggctggcaagccacgtttggtgtccctgatggttatagtgtctccagagc

SEQ ID NO: 77 - DNA, 50 bp, Artificial Sequence
  TCRB V-Segment Forward Primer With Universal Adaptor Sequence
gggctggcaagccacgtttggtgggagaagtccccaatggctacaatgtc

SEQ ID NO: 78 - DNA, 49 bp, Artificial Sequence
  TCRB V-Segment Forward Primer With Universal Adaptor Sequence
gggctggcaagccacgtttggtgaaaggagaagtcccgaatggctacaa

SEQ ID NO: 79 - DNA, 52 bp, Artificial Sequence
  TCRB V-Segment Forward Primer With Universal Adaptor Sequence
gggctggcaagccacgtttggtggttcccaatggctacaatgtctccagatc

SEQ ID NO: 80 - DNA, 55 bp, Artificial Sequence
  TCRB V-Segment Forward Primer With Universal Adaptor Sequence
gggctggcaagccacgtttggtggaagtccccaatggctacaatgtctctagatt

SEQ ID NO: 81 - DNA, 49 bp, Artificial Sequence
  TCRB V-Segment Forward Primer With Universal Adaptor Sequence
gggctggcaagccacgtttggtggagaagtccccgatggctacaatgta

SEQ ID NO: 82 - DNA, 47 bp, Artificial Sequence
  TCRB V-Segment Forward Primer With Universal Adaptor Sequence
gggctggcaagccacgtttggtggtgatcggttctctgcacagaggt

SEQ ID NO: 83 - DNA, 46 bp, Artificial Sequence
  TCRB V-Segment Forward Primer With Universal Adaptor Sequence
gggctggcaagccacgtttggtgcgcttctctgcagagaggactgg

SEQ ID NO: 84 - DNA, 45 bp, Artificial Sequence
  TCRB V-Segment Forward Primer With Universal Adaptor Sequence
gggctggcaagccacgtttggtgggttctttgcagtcaggcctga

SEQ ID NO: 85 - DNA, 45 bp, Artificial Sequence
  TCRB V-Segment Forward Primer With Universal Adaptor Sequence
gggctggcaagccacgtttggtgcagtggtcggttctctgcagag

SEQ ID NO: 86 - DNA, 52 bp, Artificial Sequence
  TCRB V-Segment Forward Primer With Universal Adaptor Sequence
gggctggcaagccacgtttggtggctcagtgatcaattctccacagagaggt

SEQ ID NO: 87 - DNA, 45 bp, Artificial Sequence
  TCRB V-Segment Forward Primer With Universal Adaptor Sequence
gggctggcaagccacgtttggtgttctctgcagagaggcctgagg

SEQ ID NO: 88 - DNA, 48 bp, Artificial Sequence
  TCRB V-Segment Forward Primer With Universal Adaptor Sequence
gggctggcaagccacgtttggtgcccagtgatcgcttctttgcagaaa

SEQ ID NO: 89 - DNA, 46 bp, Artificial Sequence
  TCRB V-Segment Forward Primer With Universal Adaptor Sequence
gggctggcaagccacgtttggtgctgcagagaggcctaagggatct

SEQ ID NO: 90 - DNA, 56 bp, Artificial Sequence
  TCRB V-Segment Forward Primer With Universal Adaptor Sequence
gggctggcaagccacgtttggtggaagggtacaatgtctctggaaacaaactcaag

SEQ ID NO: 91 - DNA, 54 bp, Artificial Sequence
  TCRB V-Segment Forward Primer With Universal Adaptor Sequence
gggctggcaagccacgtttggtgggggtactgtgtttcttgaaacaagcttgag

SEQ ID NO: 92 - DNA, 53 bp, Artificial Sequence
  TCRB V-Segment Forward Primer With Universal Adaptor Sequence
gggctggcaagccacgtttggtgcagttccctgacttgcactctgaactaaac

SEQ ID NO: 93 - DNA, 55 bp, Artificial Sequence
  TCRB V-Segment Forward Primer With Universal Adaptor Sequence
gggctggcaagccacgtttggtgactaacaaaggagaagtctcagatggctacag

SEQ ID NO: 94 - DNA, 50 bp, Artificial Sequence
  TCRB V-Segment Forward Primer With Universal Adaptor Sequence
gggctggcaagccacgtttggtgagataaaggagaagtccccgatggcta

SEQ ID NO: 95 - DNA, 58 bp, Artificial Sequence
  TCRB V-Segment Forward Primer With Universal Adaptor Sequence
gggctggcaagccacgtttggtggatactgacaaaggagaagtctcagatggctatag

SEQ ID NO: 96 - DNA, 52 bp, Artificial Sequence
  TCRB V-Segment Forward Primer With Universal Adaptor Sequence
gggctggcaagccacgtttggtgctaaggatcgattttctgcagagaggctc

SEQ ID NO: 97 - DNA, 50 bp, Artificial Sequence
  TCRB V-Segment Forward Primer With Universal Adaptor Sequence
gggctggcaagccacgtttggtgttgattctcagcacagatgcctgatgt

SEQ ID NO: 98 - DNA, 47 bp, Artificial Sequence
  TCRB V-Segment Forward Primer With Universal Adaptor Sequence
gggctggcaagccacgtttggtgattctcagctgagaggcctgatgg

SEQ ID NO: 99 - DNA, 53 bp, Artificial Sequence
  TCRB V-Segment Forward Primer With Universal Adaptor Sequence
gggctggcaagccacgtttggtgggatcgattctcagctaagatgcctaatgc

SEQ ID NO: 100 - DNA, 51 bp, Artificial Sequence
  TCRB V-Segment Forward Primer With Universal Adaptor Sequence
gggctggcaagccacgtttggtgctcagcagagatgcctgatgcaacttta

SEQ ID NO: 101 - DNA, 52 bp, Artificial Sequence
  TCRB V-Segment Forward Primer With Universal Adaptor Sequence
gggctggcaagccacgtttggtgctgatcgattctcagctcaacagttcagt

SEQ ID NO: 102 - DNA, 49 bp, Artificial Sequence
  TCRB V-Segment Forward Primer With Universal Adaptor Sequence
gggctggcaagccacgtttggtgtagctgaaaggactggagggacgtat

SEQ ID NO: 103 - DNA, 47 bp, Artificial Sequence
  TCRB V-Segment Forward Primer With Universal Adaptor Sequence
gggctggcaagccacgtttggtgccaggaggccgaacacttctttct

SEQ ID NO: 104 - DNA, 48 bp, Artificial Sequence
  TCRB V-Segment Forward Primer With Universal Adaptor Sequence
gggctggcaagccacgtttggtggctaagtgcctcccaaattcaccct

SEQ ID NO: 105 - DNA, 49 bp, Artificial Sequence
  TCRB V-Segment Forward Primer With Universal Adaptor Sequence
gggctggcaagccacgtttggtgcacagctgaaagacctaacggaacgt

SEQ ID NO: 106 - DNA, 47 bp, Artificial Sequence
  TCRB V-Segment Forward Primer With Universal Adaptor Sequence
gggctggcaagccacgtttggtgctgctgaatttcccaaagagggcc

SEQ ID NO: 107 - DNA, 43 bp, Artificial Sequence
  TCRB V-Segment Forward Primer With Universal Adaptor Sequence
gggctggcaagccacgtttggtgagggtacagcgtctctcggg

SEQ ID NO: 108 - DNA, 46 bp, Artificial Sequence
  TCRB V-Segment Forward Primer With Universal Adaptor Sequence
gggctggcaagccacgtttggtggcctgaccttgtccactctgaca

SEQ ID NO: 109 - DNA, 50 bp, Artificial Sequence
  TCRB V-Segment Forward Primer With Universal Adaptor Sequence
gggctggcaagccacgtttggtgatgagcgatttttagcccaatgctcca

SEQ ID NO: 110 - DNA, 47 bp, Artificial Sequence
  TCRB V-Segment Forward Primer With Universal Adaptor Sequence
gggctggcaagccacgtttggtgtgaaggctacgtgtctgccaagag

SEQ ID NO: 111 - DNA, 47 bp, Artificial Sequence
  TCRB V-Segment Forward Primer With Universal Adaptor Sequence
gggctggcaagccacgtttggtgctcatctcaatgccccaagaacgc

SEQ ID NO: 112 - DNA, 54 bp, Artificial Sequence
  TCRB V-Segment Forward Primer With Universal Adaptor Sequence
gggctggcaagccacgtttggtgagatctctgatggatacagtgtctctcgaca

SEQ ID NO: 113 - DNA, 57 bp, Artificial Sequence
  TCRB V-Segment Forward Primer With Universal Adaptor Sequence
gggctggcaagccacgtttggtgagatctttcctctgagtcaacagtctccagaata

SEQ ID NO: 114 - DNA, 58 bp, Artificial Sequence
  TCRB V-Segment Forward Primer With Universal Adaptor Sequence
gggctggcaagccacgtttggtgcactgaaaaaggagatatctctgaggggtatcatg

SEQ ID NO: 115 - DNA, 54 bp, Artificial Sequence
  TCRB V-Segment Forward Primer With Universal Adaptor Sequence
gggctggcaagccacgtttggtggttcctgaagggtacaaagtctctcgaaaag

SEQ ID NO: 116 - DNA, 50 bp, Artificial Sequence
  TCRB V-Segment Forward Primer With Universal Adaptor Sequence
gggctggcaagccacgtttggtgctgaggggtacagtgtctctagagaga

SEQ ID NO: 117 - DNA, 48 bp, Artificial Sequence
  TCRB V-Segment Forward Primer With Universal Adaptor Sequence
gggctggcaagccacgtttggtgagccgcccaaacctaacattctcaa

SEQ ID NO: 118 - DNA, 41 bp, Artificial Sequence
  TCRB V-Segment Forward Primer With Universal Adaptor Sequence
gggctggcaagccacgtttggtgcccaggaccggcagttca

SEQ ID NO: 119 - DNA, 63 bp, Artificial Sequence
  TCRB V-Segment Forward Primer With Universal Adaptor Sequence
gggctggcaagccacgtttggtgttgattagagacatatccctattgaaaatatttcctggca

SEQ ID NO: 120 - DNA, 54 bp, Artificial Sequence
  TCRB V-Segment Forward Primer With Universal Adaptor Sequence
gggctggcaagccacgtttggtgagatgccctgagtcagcatagtcattctaac

SEQ ID NO: 121 - DNA, 29 bp, Artificial Sequence
  TCRB J-segment Reverse Primer
gtcttacctacaactgtgagtctggtgcc

SEQ ID NO: 122 - DNA, 28 bp, Artificial Sequence
  TCRB J-segment Reverse Primer
ccttacctacaacggttaacctggtccc

SEQ ID NO: 123 - DNA, 31 bp, Artificial Sequence
  TCRB J-segment Reverse Primer
cttactcacctacaacagtgagccaacttcc

SEQ ID NO: 124 - DNA, 26 bp, Artificial Sequence
  TCRB J-segment Reverse Primer
atacccaagacagagagctgggttcc

SEQ ID NO: 125 - DNA, 29 bp, Artificial Sequence
  TCRB J-segment Reverse Primer
aacttacctaggatggagagtcgagtccc

SEQ ID NO: 126 - DNA, 22 bp, Artificial Sequence
  TCRB J-segment Reverse Primer
ctgtcacagtgagcctggtccc

SEQ ID NO: 127 - DNA, 18 bp, Artificial Sequence
  TCRB J-segment Reverse Primer
cacggtgagccgtgtccc

SEQ ID NO: 128 - DNA, 22 bp, Artificial Sequence
  TCRB J-segment Reverse Primer
ccagtacggtcagcctagagcc

SEQ ID NO: 129 - DNA, 18 bp, Artificial Sequence
  TCRB J-segment Reverse Primer
cactgtcagccgggtgcc

SEQ ID NO: 130 - DNA, 18 bp, Artificial Sequence
  TCRB J-segment Reverse Primer
cactgagagccgggtccc

SEQ ID NO: 131 - DNA, 17 bp, Artificial Sequence
  TCRB J-segment Reverse Primer
accaggagccgcgtgcc

SEQ ID NO: 132 - DNA, 18 bp, Artificial Sequence
  TCRB J-segment Reverse Primer
cacggtcagcctgctgcc

SEQ ID NO: 133 - DNA, 18 bp, Artificial Sequence
  TCRB J-segment Reverse Primer
gaccgtgagcctggtgcc

SEQ ID NO: 134 - DNA, 52 bp, Artificial Sequence
  TCRB J-segment Reverse Primer With Universal Adaptor Sequence
ccgggagctgcatgtgtcagagggtcttacctacaactgtgagtctggtgcc

SEQ ID NO: 135 - DNA, 51 bp, Artificial Sequence
  TCRB J-segment Reverse Primer With Universal Adaptor Sequence
ccgggagctgcatgtgtcagaggccttacctacaacggttaacctggtccc

SEQ ID NO: 136 - DNA, 54 bp, Artificial Sequence
  TCRB J-segment Reverse Primer With Universal Adaptor Sequence
ccgggagctgcatgtgtcagaggcttactcacctacaacagtgagccaacttcc

SEQ ID NO: 137 - DNA, 49 bp, Artificial Sequence
  TCRB J-segment Reverse Primer With Universal Adaptor Sequence
ccgggagctgcatgtgtcagaggatacccaagacagagagctgggttcc

SEQ ID NO: 138 - DNA, 52 bp, Artificial Sequence
  TCRB J-segment Reverse Primer With Universal Adaptor Sequence
ccgggagctgcatgtgtcagaggaacttacctaggatggagagtcgagtccc

SEQ ID NO: 139 - DNA, 45 bp, Artificial Sequence
  TCRB J-segment Reverse Primer With Universal Adaptor Sequence
ccgggagctgcatgtgtcagaggctgtcacagtgagcctggtccc

SEQ ID NO: 140 - DNA, 41 bp, Artificial Sequence
  TCRB J-segment Reverse Primer With Universal Adaptor Sequence
ccgggagctgcatgtgtcagaggcacggtgagccgtgtccc

SEQ ID NO: 141 - DNA, 45 bp, Artificial Sequence
  TCRB J-segment Reverse Primer With Universal Adaptor Sequence
ccgggagctgcatgtgtcagaggccagtacggtcagcctagagcc

SEQ ID NO: 142 - DNA, 41 bp, Artificial Sequence
  TCRB J-segment Reverse Primer With Universal Adaptor Sequence
ccgggagctgcatgtgtcagaggcactgtcagccgggtgcc

SEQ ID NO: 143 - DNA, 47 bp, Artificial Sequence
  TCRB J-segment Reverse Primer With Universal Adaptor Sequence
gtcttacctacaactgtgagtctggtgcccactgagagccgggtccc

SEQ ID NO: 144 - DNA, 40 bp, Artificial Sequence
  TCRB J-segment Reverse Primer With Universal Adaptor Sequence
ccgggagctgcatgtgtcagaggaccaggagccgcgtgcc

SEQ ID NO: 145 - DNA, 41 bp, Artificial Sequence
  TCRB J-segment Reverse Primer With Universal Adaptor Sequence
ccgggagctgcatgtgtcagaggcacggtcagcctgctgcc

SEQ ID NO: 146 - DNA, 41 bp, Artificial Sequence
  TCRB J-segment Reverse Primer With Universal Adaptor Sequence
ccgggagctgcatgtgtcagagggaccgtgagcctggtgcc

SEQ ID NO: 147 - DNA, 26 bp, Artificial Sequence
  TCRG V-segment Forward Primer
ggaggggaaggccccacagcgtcttc

SEQ ID NO: 148 - DNA, 27 bp, Artificial Sequence
  TCRG V-segment Forward Primer
tgaagtcatacagttcctggtgtccat

SEQ ID NO: 149 - DNA, 28 bp, Artificial Sequence
  TCRG V-segment Forward Primer
ccaaatcaggctttggagcacctgatct

SEQ ID NO: 150 - DNA, 33 bp, Artificial Sequence
  TCRG V-segment Forward Primer
ccaaacaaaggcttagaatatttattacatgtc

SEQ ID NO: 151 - DNA, 27 bp, Artificial Sequence
  TCRG V-segment Forward Primer
ccaggtccctgaggcactccaccagct

SEQ ID NO: 152 - DNA, 28 bp, Artificial Sequence
  TCRG V-segment Forward Primer
ctgaatctaaattatgagccatctgaca

SEQ ID NO: 153 - DNA, 49 bp, Artificial Sequence
  TCRG V-segment Forward Primer With Universal Adaptor
gggctggcaagccacgtttggtgggaggggaaggccccacagcgtcttc

SEQ ID NO: 154 - DNA, 50 bp, Artificial Sequence
  TCRG V-segment Forward Primer With Universal Adaptor
gggctggcaagccacgtttggtgtgaagtcatacagttcctggtgtccat

SEQ ID NO: 155 - DNA, 51 bp, Artificial Sequence
  TCRG V-segment Forward Primer With Universal Adaptor
gggctggcaagccacgtttggtgccaaatcaggctttggagcacctgatct

SEQ ID NO: 156 - DNA, 56 bp, Artificial Sequence
  TCRG V-segment Forward Primer With Universal Adaptor
gggctggcaagccacgtttggtgccaaacaaaggcttagaatatttattacatgtc

SEQ ID NO: 157 - DNA, 50 bp, Artificial Sequence
  TCRG V-segment Forward Primer With Universal Adaptor
gggctggcaagccacgtttggtgccaggtccctgaggcactccaccagct

SEQ ID NO: 158 - DNA, 51 bp, Artificial Sequence
  TCRG V-segment Forward Primer With Universal Adaptor
gggctggcaagccacgtttggtgctgaatctaaattatgagccatctgaca

SEQ ID NO: 159 - DNA, 34 bp, Artificial Sequence
  TCRG J-segment Reverse Primer
gtgaagttactatgagcttagtcccttcagcaaa

SEQ ID NO: 160 - DNA, 33 bp, Artificial Sequence
  TCRG J-segment Reverse Primer
cgaagttactatgagcctagtcccttttgcaaa

SEQ ID NO: 161 - DNA, 28 bp, Artificial Sequence
  TCRG J-segment Reverse Primer
tgacaacaagtgttgttccactgccaaa

SEQ ID NO: 162 - DNA, 31 bp, Artificial Sequence
  TCRG J-segment Reverse Primer
ctgtaatgataagctttgttccgggaccaaa

SEQ ID NO: 163 - DNA, 57 bp, Artificial Sequence
  TCRG J-segment Reverse Primer With Universal Adaptor
ccgggagctgcatgtgtcagagggtgaagttactatgagcttagtcccttcagcaaa

SEQ ID NO: 164 - DNA, 56 bp, Artificial Sequence
  TCRG J-segment Reverse Primer With Universal Adaptor
ccgggagctgcatgtgtcagaggcgaagttactatgagcctagtcccttttgcaaa

SEQ ID NO: 165 - DNA, 51 bp, Artificial Sequence
  TCRG J-segment Reverse Primer With Universal Adaptor
ccgggagctgcatgtgtcagaggtgacaacaagtgttgttccactgccaaa

SEQ ID NO: 166 - DNA, 54 bp, Artificial Sequence
  TCRG J-segment Reverse Primer With Universal Adaptor
ccgggagctgcatgtgtcagaggctgtaatgataagctttgttccgggaccaaa

SEQ ID NO: 167 - DNA, 32 bp, Artificial Sequence
  TCRA  V-segment Forward Primer
tcattccttagtcgctctgatagttatggtta

SEQ ID NO: 168 - DNA, 31 bp, Artificial Sequence
  TCRA  V-segment Forward Primer
cattccttagtcggtctaaagggtacagtta

SEQ ID NO: 169 - DNA, 31 bp, Artificial Sequence
  TCRA  V-segment Forward Primer
acaacatgacctatgaacggttctcttcatc

SEQ ID NO: 170 - DNA, 31 bp, Artificial Sequence
  TCRA  V-segment Forward Primer
ctgaatttaacaagagccaaacctccttcca

SEQ ID NO: 171 - DNA, 25 bp, Artificial Sequence
  TCRA  V-segment Forward Primer
ccgacagaaagtccagcactctgag

SEQ ID NO: 172 - DNA, 36 bp, Artificial Sequence
  TCRA  V-segment Forward Primer
cactgttctattgaataaaaaggataaacatctgtc

SEQ ID NO: 173 - DNA, 32 bp, Artificial Sequence
  TCRA  V-segment Forward Primer
gtcacctttgataccacccttaaacagagttt

SEQ ID NO: 174 - DNA, 35 bp, Artificial Sequence
  TCRA  V-segment Forward Primer
agactaaatgctacattactgaagaatggaagcag

SEQ ID NO: 175 - DNA, 36 bp, Artificial Sequence
  TCRA  V-segment Forward Primer
tgaggctgaatttataaagagtaaattctcctttaa

SEQ ID NO: 176 - DNA, 32 bp, Artificial Sequence
  TCRA  V-segment Forward Primer
gctgaatttaagaagagtgaaacctccttcca

SEQ ID NO: 177 - DNA, 33 bp, Artificial Sequence
  TCRA  V-segment Forward Primer
ggctgaatttaagaggagtcaatcttccttcaa

SEQ ID NO: 178 - DNA, 30 bp, Artificial Sequence
  TCRA  V-segment Forward Primer
gacacttatcacttccccaatcaatacccc

SEQ ID NO: 179 - DNA, 33 bp, Artificial Sequence
  TCRA  V-segment Forward Primer
ggctgaatttaacaagagtcaaacttccttcca

SEQ ID NO: 180 - DNA, 32 bp, Artificial Sequence
  TCRA  V-segment Forward Primer
gctgaatttaagaagagcgaaacctccttcta

SEQ ID NO: 181 - DNA, 31 bp, Artificial Sequence
  TCRA  V-segment Forward Primer
ccatgtaccgtaaagaaaccacttctttcca

SEQ ID NO: 182 - DNA, 31 bp, Artificial Sequence
  TCRA  V-segment Forward Primer
ccacataccgtaaagaaaccacttctttcca

SEQ ID NO: 183 - DNA, 25 bp, Artificial Sequence
  TCRA  V-segment Forward Primer
tggatgcagacacaaagcaaagctc

SEQ ID NO: 184 - DNA, 36 bp, Artificial Sequence
  TCRA  V-segment Forward Primer
taaagaactgcttggaaaagaaaaattttatagtgt

SEQ ID NO: 185 - DNA, 30 bp, Artificial Sequence
  TCRA  V-segment Forward Primer
acagctcaatagagccagccagtatatttc

SEQ ID NO: 186 - DNA, 29 bp, Artificial Sequence
  TCRA  V-segment Forward Primer
cagctcaataaagccagccagtatgtttc

SEQ ID NO: 187 - DNA, 32 bp, Artificial Sequence
  TCRA  V-segment Forward Primer
gcacaggtcgataaatccagcaagtatatctc

SEQ ID NO: 188 - DNA, 34 bp, Artificial Sequence
  TCRA  V-segment Forward Primer
ctgttacattgaacaagacagccaaacatttctc

SEQ ID NO: 189 - DNA, 36 bp, Artificial Sequence
  TCRA  V-segment Forward Primer
caccgttttattgaataagacagtgaaacatctctc

SEQ ID NO: 190 - DNA, 24 bp, Artificial Sequence
  TCRA  V-segment Forward Primer
ccagaaggcaagaaaatccgccaa

SEQ ID NO: 191 - DNA, 33 bp, Artificial Sequence
  TCRA  V-segment Forward Primer
agaagcgcttggaaaagagaagttttatagtgt

SEQ ID NO: 192 - DNA, 30 bp, Artificial Sequence
  TCRA  V-segment Forward Primer
tgaccttaacaaaggcgagacatctttcca

SEQ ID NO: 193 - DNA, 28 bp, Artificial Sequence
  TCRA  V-segment Forward Primer
cgcttgacacttccaagaaaagcagttc

SEQ ID NO: 194 - DNA, 30 bp, Artificial Sequence
  TCRA  V-segment Forward Primer
cagtcctatcaagagtgacagttccttcca

SEQ ID NO: 195 - DNA, 30 bp, Artificial Sequence
  TCRA  V-segment Forward Primer
gaacttccagaaatccaccagttccttcaa

SEQ ID NO: 196 - DNA, 33 bp, Artificial Sequence
  TCRA  V-segment Forward Primer
gctaaaagccacattaacaaagaaggaaagctt

SEQ ID NO: 197 - DNA, 30 bp, Artificial Sequence
  TCRA  V-segment Forward Primer
ctcgctggataaatcatcaggacgtagtac

SEQ ID NO: 198 - DNA, 22 bp, Artificial Sequence
  TCRA  V-segment Forward Primer
tcgctacggaacgctacagctt

SEQ ID NO: 199 - DNA, 30 bp, Artificial Sequence
  TCRA  V-segment Forward Primer
ctccttcaataaaagtgccaagcagttctc

SEQ ID NO: 200 - DNA, 30 bp, Artificial Sequence
  TCRA  V-segment Forward Primer
cactcttaataccaaggagggttacagcta

SEQ ID NO: 201 - DNA, 30 bp, Artificial Sequence
  TCRA  V-segment Forward Primer
tcagtttggagaagcaaaaaagaacagctc

SEQ ID NO: 202 - DNA, 30 bp, Artificial Sequence
  TCRA  V-segment Forward Primer
gatcatcacagaagacagaaagtccagcac

SEQ ID NO: 203 - DNA, 29 bp, Artificial Sequence
  TCRA  V-segment Forward Primer
gcaatcgctgaagacagaaagtccagtac

SEQ ID NO: 204 - DNA, 29 bp, Artificial Sequence
  TCRA  V-segment Forward Primer
cagtttggtgatgcaagaaaggacagttc

SEQ ID NO: 205 - DNA, 28 bp, Artificial Sequence
  TCRA  V-segment Forward Primer
cagtcaaagctgaggaactttatggcca

SEQ ID NO: 206 - DNA, 30 bp, Artificial Sequence
  TCRA  V-segment Forward Primer
cttcttaaacaaaagtgccaagcacctctc

SEQ ID NO: 207 - DNA, 34 bp, Artificial Sequence
  TCRA  V-segment Forward Primer
ctgcttcatttaatgaaaaaaagcagcaaagctc

SEQ ID NO: 208 - DNA, 36 bp, Artificial Sequence
  TCRA  V-segment Forward Primer
ttctgtgagcttccagaaaacaactaaaactattca

SEQ ID NO: 209 - DNA, 36 bp, Artificial Sequence
  TCRA  V-segment Forward Primer
cactgtactgttgaataaaaatgctaaacatgtctc

SEQ ID NO: 210 - DNA, 36 bp, Artificial Sequence
  TCRA  V-segment Forward Primer
gcctgtgaactttgaaaaaaagaaaaagttcatcaa

SEQ ID NO: 211 - DNA, 31 bp, Artificial Sequence
  TCRA  V-segment Forward Primer
ccaagttggatgagaaaaagcagcaaagttc

SEQ ID NO: 212 - DNA, 30 bp, Artificial Sequence
  TCRA  V-segment Forward Primer
tcagtttggtataaccagaaaggacagctt

SEQ ID NO: 213 - DNA, 36 bp, Artificial Sequence
  TCRA  V-segment Forward Primer
aagtagcatattagataagaaagaactttccagcat

SEQ ID NO: 214 - DNA, 30 bp, Artificial Sequence
  TCRA  V-segment Forward Primer
caggcttaaaaaaggagaccagcacatttc

SEQ ID NO: 215 - DNA, 27 bp, Artificial Sequence
  TCRA  V-segment Forward Primer
cttccagaaagcagccaaatccttcag

SEQ ID NO: 216 - DNA, 24 bp, Artificial Sequence
  TCRA  V-segment Forward Primer
tgataccaaagcccgtctcagcac

SEQ ID NO: 217 - DNA, 31 bp, Artificial Sequence
  TCRA  V-segment Forward Primer
gaggcggaaatattaaagacaaaaactcccc

SEQ ID NO: 218 - DNA, 31 bp, Artificial Sequence
  TCRA  V-segment Forward Primer
ccacaataaacatacaggaaaagcacagctc

SEQ ID NO: 219 - DNA, 22 bp, Artificial Sequence
  TCRD V-segment Forward Primer
agaaagcagcgaaatccgtcgc

SEQ ID NO: 220 - DNA, 30 bp, Artificial Sequence
  TCRD V-segment Forward Primer
tgacattgatattgcaaagaacctggctgt

SEQ ID NO: 221 - DNA, 30 bp, Artificial Sequence
  TCRD V-segment Forward Primer
gaaacacattctgacccagaaagcctttca

SEQ ID NO: 222 - DNA, 55 bp, Artificial Sequence
  TCRA V-segment Forward Primer With Universal Adaptor
gggctggcaagccacgtttggtgtcattccttagtcgctctgatagttatggtta

SEQ ID NO: 223 - DNA, 54 bp, Artificial Sequence
  TCRA V-segment Forward Primer With Universal Adaptor
gggctggcaagccacgtttggtgcattccttagtcggtctaaagggtacagtta

SEQ ID NO: 224 - DNA, 54 bp, Artificial Sequence
  TCRA V-segment Forward Primer With Universal Adaptor
gggctggcaagccacgtttggtgacaacatgacctatgaacggttctcttcatc

SEQ ID NO: 225 - DNA, 54 bp, Artificial Sequence
  TCRA V-segment Forward Primer With Universal Adaptor
gggctggcaagccacgtttggtgctgaatttaacaagagccaaacctccttcca

SEQ ID NO: 226 - DNA, 48 bp, Artificial Sequence
  TCRA V-segment Forward Primer With Universal Adaptor
gggctggcaagccacgtttggtgccgacagaaagtccagcactctgag

SEQ ID NO: 227 - DNA, 59 bp, Artificial Sequence
  TCRA V-segment Forward Primer With Universal Adaptor
gggctggcaagccacgtttggtgcactgttctattgaataaaaaggataaacatctgtc

SEQ ID NO: 228 - DNA, 55 bp, Artificial Sequence
  TCRA V-segment Forward Primer With Universal Adaptor
gggctggcaagccacgtttggtggtcacctttgataccacccttaaacagagttt

SEQ ID NO: 229 - DNA, 58 bp, Artificial Sequence
  TCRA V-segment Forward Primer With Universal Adaptor
gggctggcaagccacgtttggtgagactaaatgctacattactgaagaatggaagcag

SEQ ID NO: 230 - DNA, 59 bp, Artificial Sequence
  TCRA V-segment Forward Primer With Universal Adaptor
gggctggcaagccacgtttggtgtgaggctgaatttataaagagtaaattctcctttaa

SEQ ID NO: 231 - DNA, 55 bp, Artificial Sequence
  TCRA V-segment Forward Primer With Universal Adaptor
gggctggcaagccacgtttggtggctgaatttaagaagagtgaaacctccttcca

SEQ ID NO: 232 - DNA, 56 bp, Artificial Sequence
  TCRA V-segment Forward Primer With Universal Adaptor
gggctggcaagccacgtttggtgggctgaatttaagaggagtcaatcttccttcaa

SEQ ID NO: 233 - DNA, 53 bp, Artificial Sequence
  TCRA V-segment Forward Primer With Universal Adaptor
gggctggcaagccacgtttggtggacacttatcacttccccaatcaatacccc

SEQ ID NO: 234 - DNA, 56 bp, Artificial Sequence
  TCRA V-segment Forward Primer With Universal Adaptor
gggctggcaagccacgtttggtgggctgaatttaacaagagtcaaacttccttcca

SEQ ID NO: 235 - DNA, 55 bp, Artificial Sequence
  TCRA V-segment Forward Primer With Universal Adaptor
gggctggcaagccacgtttggtggctgaatttaagaagagcgaaacctccttcta

SEQ ID NO: 236 - DNA, 54 bp, Artificial Sequence
  TCRA V-segment Forward Primer With Universal Adaptor
gggctggcaagccacgtttggtgccatgtaccgtaaagaaaccacttctttcca

SEQ ID NO: 237 - DNA, 54 bp, Artificial Sequence
  TCRA V-segment Forward Primer With Universal Adaptor
gggctggcaagccacgtttggtgccacataccgtaaagaaaccacttctttcca

SEQ ID NO: 238 - DNA, 48 bp, Artificial Sequence
  TCRA V-segment Forward Primer With Universal Adaptor
gggctggcaagccacgtttggtgtggatgcagacacaaagcaaagctc

SEQ ID NO: 239 - DNA, 59 bp, Artificial Sequence
  TCRA V-segment Forward Primer With Universal Adaptor
gggctggcaagccacgtttggtgtaaagaactgcttggaaaagaaaaattttatagtgt

SEQ ID NO: 240 - DNA, 53 bp, Artificial Sequence
  TCRA V-segment Forward Primer With Universal Adaptor
gggctggcaagccacgtttggtgacagctcaatagagccagccagtatatttc

SEQ ID NO: 241 - DNA, 52 bp, Artificial Sequence
  TCRA V-segment Forward Primer With Universal Adaptor
gggctggcaagccacgtttggtgcagctcaataaagccagccagtatgtttc

SEQ ID NO: 242 - DNA, 55 bp, Artificial Sequence
  TCRA V-segment Forward Primer With Universal Adaptor
gggctggcaagccacgtttggtggcacaggtcgataaatccagcaagtatatctc

SEQ ID NO: 243 - DNA, 57 bp, Artificial Sequence
  TCRA V-segment Forward Primer With Universal Adaptor
gggctggcaagccacgtttggtgctgttacattgaacaagacagccaaacatttctc

SEQ ID NO: 244 - DNA, 59 bp, Artificial Sequence
  TCRA V-segment Forward Primer With Universal Adaptor
gggctggcaagccacgtttggtgcaccgttttattgaataagacagtgaaacatctctc

SEQ ID NO: 245 - DNA, 47 bp, Artificial Sequence
  TCRA V-segment Forward Primer With Universal Adaptor
gggctggcaagccacgtttggtgccagaaggcaagaaaatccgccaa

SEQ ID NO: 246 - DNA, 56 bp, Artificial Sequence
  TCRA V-segment Forward Primer With Universal Adaptor
gggctggcaagccacgtttggtgagaagcgcttggaaaagagaagttttatagtgt

SEQ ID NO: 247 - DNA, 53 bp, Artificial Sequence
  TCRA V-segment Forward Primer With Universal Adaptor
gggctggcaagccacgtttggtgtgaccttaacaaaggcgagacatctttcca

SEQ ID NO: 248 - DNA, 51 bp, Artificial Sequence
  TCRA V-segment Forward Primer With Universal Adaptor
gggctggcaagccacgtttggtgcgcttgacacttccaagaaaagcagttc

SEQ ID NO: 249 - DNA, 53 bp, Artificial Sequence
  TCRA V-segment Forward Primer With Universal Adaptor
gggctggcaagccacgtttggtgcagtcctatcaagagtgacagttccttcca

SEQ ID NO: 250 - DNA, 53 bp, Artificial Sequence
  TCRA V-segment Forward Primer With Universal Adaptor
gggctggcaagccacgtttggtggaacttccagaaatccaccagttccttcaa

SEQ ID NO: 251 - DNA, 56 bp, Artificial Sequence
  TCRA V-segment Forward Primer With Universal Adaptor
gggctggcaagccacgtttggtggctaaaagccacattaacaaagaaggaaagctt

SEQ ID NO: 252 - DNA, 53 bp, Artificial Sequence
  TCRA V-segment Forward Primer With Universal Adaptor
gggctggcaagccacgtttggtgctcgctggataaatcatcaggacgtagtac

SEQ ID NO: 253 - DNA, 45 bp, Artificial Sequence
  TCRA V-segment Forward Primer With Universal Adaptor
gggctggcaagccacgtttggtgtcgctacggaacgctacagctt

SEQ ID NO: 254 - DNA, 53 bp, Artificial Sequence
  TCRA V-segment Forward Primer With Universal Adaptor
gggctggcaagccacgtttggtgctccttcaataaaagtgccaagcagttctc

SEQ ID NO: 255 - DNA, 53 bp, Artificial Sequence
  TCRA V-segment Forward Primer With Universal Adaptor
gggctggcaagccacgtttggtgcactcttaataccaaggagggttacagcta

SEQ ID NO: 256 - DNA, 53 bp, Artificial Sequence
  TCRA V-segment Forward Primer With Universal Adaptor
gggctggcaagccacgtttggtgtcagtttggagaagcaaaaaagaacagctc

SEQ ID NO: 257 - DNA, 53 bp, Artificial Sequence
  TCRA V-segment Forward Primer With Universal Adaptor
gggctggcaagccacgtttggtggatcatcacagaagacagaaagtccagcac

SEQ ID NO: 258 - DNA, 52 bp, Artificial Sequence
  TCRA V-segment Forward Primer With Universal Adaptor
gggctggcaagccacgtttggtggcaatcgctgaagacagaaagtccagtac

SEQ ID NO: 259 - DNA, 52 bp, Artificial Sequence
  TCRA V-segment Forward Primer With Universal Adaptor
gggctggcaagccacgtttggtgcagtttggtgatgcaagaaaggacagttc

SEQ ID NO: 260 - DNA, 51 bp, Artificial Sequence
  TCRA V-segment Forward Primer With Universal Adaptor
gggctggcaagccacgtttggtgcagtcaaagctgaggaactttatggcca

SEQ ID NO: 261 - DNA, 53 bp, Artificial Sequence
  TCRA V-segment Forward Primer With Universal Adaptor
gggctggcaagccacgtttggtgcttcttaaacaaaagtgccaagcacctctc

SEQ ID NO: 262 - DNA, 57 bp, Artificial Sequence
  TCRA V-segment Forward Primer With Universal Adaptor
gggctggcaagccacgtttggtgctgcttcatttaatgaaaaaaagcagcaaagctc

SEQ ID NO: 263 - DNA, 59 bp, Artificial Sequence
  TCRA V-segment Forward Primer With Universal Adaptor
gggctggcaagccacgtttggtgttctgtgagcttccagaaaacaactaaaactattca

SEQ ID NO: 264 - DNA, 59 bp, Artificial Sequence
  TCRA V-segment Forward Primer With Universal Adaptor
gggctggcaagccacgtttggtgcactgtactgttgaataaaaatgctaaacatgtctc

SEQ ID NO: 265 - DNA, 59 bp, Artificial Sequence
  TCRA V-segment Forward Primer With Universal Adaptor
gggctggcaagccacgtttggtggcctgtgaactttgaaaaaaagaaaaagttcatcaa

SEQ ID NO: 266 - DNA, 54 bp, Artificial Sequence
  TCRA V-segment Forward Primer With Universal Adaptor
gggctggcaagccacgtttggtgccaagttggatgagaaaaagcagcaaagttc

SEQ ID NO: 267 - DNA, 53 bp, Artificial Sequence
  TCRA V-segment Forward Primer With Universal Adaptor
gggctggcaagccacgtttggtgtcagtttggtataaccagaaaggacagctt

SEQ ID NO: 268 - DNA, 59 bp, Artificial Sequence
  TCRA V-segment Forward Primer With Universal Adaptor
gggctggcaagccacgtttggtgaagtagcatattagataagaaagaactttccagcat

SEQ ID NO: 269 - DNA, 53 bp, Artificial Sequence
  TCRA V-segment Forward Primer With Universal Adaptor
gggctggcaagccacgtttggtgcaggcttaaaaaaggagaccagcacatttc

SEQ ID NO: 270 - DNA, 50 bp, Artificial Sequence
  TCRA V-segment Forward Primer With Universal Adaptor
gggctggcaagccacgtttggtgcttccagaaagcagccaaatccttcag

SEQ ID NO: 271 - DNA, 47 bp, Artificial Sequence
  TCRA V-segment Forward Primer With Universal Adaptor
gggctggcaagccacgtttggtgtgataccaaagcccgtctcagcac

SEQ ID NO: 272 - DNA, 54 bp, Artificial Sequence
  TCRA V-segment Forward Primer With Universal Adaptor
gggctggcaagccacgtttggtggaggcggaaatattaaagacaaaaactcccc

SEQ ID NO: 273 - DNA, 54 bp, Artificial Sequence
  TCRA V-segment Forward Primer With Universal Adaptor
gggctggcaagccacgtttggtgccacaataaacatacaggaaaagcacagctc

SEQ ID NO: 274 - DNA, 45 bp, Artificial Sequence
  TCRD V-segment Forward Primer With Universal Adaptor
gggctggcaagccacgtttggtgagaaagcagcgaaatccgtcgc

SEQ ID NO: 275 - DNA, 53 bp, Artificial Sequence
  TCRD V-segment Forward Primer With Universal Adaptor
gggctggcaagccacgtttggtgtgacattgatattgcaaagaacctggctgt

SEQ ID NO: 276 - DNA, 53 bp, Artificial Sequence
  TCRD V-segment Forward Primer With Universal Adaptor
gggctggcaagccacgtttggtggaaacacattctgacccagaaagcctttca

SEQ ID NO: 277 - DNA, 25 bp, Artificial Sequence
  TCRA J-segment Reverse Primer
ggggagaagtggaaactctggttcc

SEQ ID NO: 278 - DNA, 32 bp, Artificial Sequence
  TCRA J-segment Reverse Primer
gactcaccagatataatgaatacatgggtccc

SEQ ID NO: 279 - DNA, 21 bp, Artificial Sequence
  TCRA J-segment Reverse Primer
ccggatgctgagtctggtccc

SEQ ID NO: 280 - DNA, 20 bp, Artificial Sequence
  TCRA J-segment Reverse Primer
tgtacagccagcctggtccc

SEQ ID NO: 281 - DNA, 26 bp, Artificial Sequence
  TCRA J-segment Reverse Primer
cttggttgcacttggagtcttgttcc

SEQ ID NO: 282 - DNA, 26 bp, Artificial Sequence
  TCRA J-segment Reverse Primer
cacggatgaacaataaggctggttcc

SEQ ID NO: 283 - DNA, 25 bp, Artificial Sequence
  TCRA J-segment Reverse Primer
ttggtatgaccaccacttggttccc

SEQ ID NO: 284 - DNA, 21 bp, Artificial Sequence
  TCRA J-segment Reverse Primer
actgaccagaagtcgggtgcc

SEQ ID NO: 285 - DNA, 36 bp, Artificial Sequence
  TCRA J-segment Reverse Primer
atggaacttacttgctttaacaaatagtcttgttcc

SEQ ID NO: 286 - DNA, 27 bp, Artificial Sequence
  TCRA J-segment Reverse Primer
actgagttccacttttagctgagtgcc

SEQ ID NO: 287 - DNA, 27 bp, Artificial Sequence
  TCRA J-segment Reverse Primer
acctggagagactagaagcatagtccc

SEQ ID NO: 288 - DNA, 21 bp, Artificial Sequence
  TCRA J-segment Reverse Primer
cctgaccagcagtctggtccc

SEQ ID NO: 289 - DNA, 26 bp, Artificial Sequence
  TCRA J-segment Reverse Primer
cttgggatgacttggagctttgttcc

SEQ ID NO: 290 - DNA, 34 bp, Artificial Sequence
  TCRA J-segment Reverse Primer
cctacttaccaggttttactgataatcttgtccc

SEQ ID NO: 291 - DNA, 30 bp, Artificial Sequence
  TCRA J-segment Reverse Primer
ctggaactcactgataaggtggttcccttc

SEQ ID NO: 292 - DNA, 32 bp, Artificial Sequence
  TCRA J-segment Reverse Primer
tacttactaagatccacctttaacatggttcc

SEQ ID NO: 293 - DNA, 27 bp, Artificial Sequence
  TCRA J-segment Reverse Primer
acttggtttaactagcaccctggttcc

SEQ ID NO: 294 - DNA, 24 bp, Artificial Sequence
  TCRA J-segment Reverse Primer
aggccagacagtcaactgagttcc

SEQ ID NO: 295 - DNA, 34 bp, Artificial Sequence
  TCRA J-segment Reverse Primer
ctcacttacttggagtgacattatgtttggatcc

SEQ ID NO: 296 - DNA, 32 bp, Artificial Sequence
  TCRA J-segment Reverse Primer
tacttacttgctcttacagttactgtggttcc

SEQ ID NO: 297 - DNA, 33 bp, Artificial Sequence
  TCRA J-segment Reverse Primer
taacttacttggttttacattgagtttggtccc

SEQ ID NO: 298 - DNA, 28 bp, Artificial Sequence
  TCRA J-segment Reverse Primer
taccaggtaaaacagtcaattgtgtccc

SEQ ID NO: 299 - DNA, 27 bp, Artificial Sequence
  TCRA J-segment Reverse Primer
actgggtttcacagataactccgttcc

SEQ ID NO: 300 - DNA, 21 bp, Artificial Sequence
  TCRA J-segment Reverse Primer
ggtgaccacaacctgggtccc

SEQ ID NO: 301 - DNA, 22 bp, Artificial Sequence
  TCRA J-segment Reverse Primer
gcttgacaagcagccttgtccc

SEQ ID NO: 302 - DNA, 22 bp, Artificial Sequence
  TCRA J-segment Reverse Primer
gcagcacggacaatctggttcc

SEQ ID NO: 303 - DNA, 23 bp, Artificial Sequence
  TCRA J-segment Reverse Primer
ggcttcacagtgagcgtagtccc

SEQ ID NO: 304 - DNA, 26 bp, Artificial Sequence
  TCRA J-segment Reverse Primer
cttggtatgaccgagagtttggtccc

SEQ ID NO: 305 - DNA, 27 bp, Artificial Sequence
  TCRA J-segment Reverse Primer
acttgcaatcacagaaagtcttgtgcc

SEQ ID NO: 306 - DNA, 26 bp, Artificial Sequence
  TCRA J-segment Reverse Primer
ctggggagaatatgaagtcgtgtccc

SEQ ID NO: 307 - DNA, 22 bp, Artificial Sequence
  TCRA J-segment Reverse Primer
gcttcaccaccagctgagttcc

SEQ ID NO: 308 - DNA, 21 bp, Artificial Sequence
  TCRA J-segment Reverse Primer
ctggacagcaagcagagtgcc

SEQ ID NO: 309 - DNA, 32 bp, Artificial Sequence
  TCRA J-segment Reverse Primer
gacttacctggctttataattagcttggtccc

SEQ ID NO: 310 - DNA, 32 bp, Artificial Sequence
  TCRA J-segment Reverse Primer
tacttacttggaaagacttgtaatctggtccc

SEQ ID NO: 311 - DNA, 30 bp, Artificial Sequence
  TCRA J-segment Reverse Primer
cttacgtggtaaaacaatcacttgagtgcc

SEQ ID NO: 312 - DNA, 25 bp, Artificial Sequence
  TCRA J-segment Reverse Primer
ggggaataacggtgagtctcgttcc

SEQ ID NO: 313 - DNA, 31 bp, Artificial Sequence
  TCRA J-segment Reverse Primer
cctacctggttttacttggtaaagttgtccc

SEQ ID NO: 314 - DNA, 24 bp, Artificial Sequence
  TCRA J-segment Reverse Primer
cggatttactgccaggcttgttcc

SEQ ID NO: 315 - DNA, 26 bp, Artificial Sequence
  TCRA J-segment Reverse Primer
cggggtttgaccattaaccttgttcc

SEQ ID NO: 316 - DNA, 23 bp, Artificial Sequence
  TCRA J-segment Reverse Primer
gctaaaaccttcagcctggtgcc

SEQ ID NO: 317 - DNA, 20 bp, Artificial Sequence
  TCRA J-segment Reverse Primer
gtgaccaacagcgaggtgcc

SEQ ID NO: 318 - DNA, 33 bp, Artificial Sequence
  TCRA J-segment Reverse Primer
acacttacttggtttaacagagagtttagtgcc

SEQ ID NO: 319 - DNA, 27 bp, Artificial Sequence
  TCRA J-segment Reverse Primer
acttggttttactgtcagtctggtccc

SEQ ID NO: 320 - DNA, 25 bp, Artificial Sequence
  TCRA J-segment Reverse Primer
cgagcgtgacctgaagtcttgttcc

SEQ ID NO: 321 - DNA, 26 bp, Artificial Sequence
  TCRA J-segment Reverse Primer
cagggctggatgattagatgagtccc

SEQ ID NO: 322 - DNA, 24 bp, Artificial Sequence
  TCRA J-segment Reverse Primer
gggcctaactgctaaacgagtccc

SEQ ID NO: 323 - DNA, 28 bp, Artificial Sequence
  TCRA J-segment Reverse Primer
cacaggacttgactctcagaatggttcc

SEQ ID NO: 324 - DNA, 27 bp, Artificial Sequence
  TCRA J-segment Reverse Primer
actgggtatgatggtgagtcttgttcc

SEQ ID NO: 325 - DNA, 26 bp, Artificial Sequence
  TCRA J-segment Reverse Primer
cttggaatgaccgtcaaacttgtccc

SEQ ID NO: 326 - DNA, 31 bp, Artificial Sequence
  TCRA J-segment Reverse Primer
acttacttggaatgactgataagcttgtccc

SEQ ID NO: 327 - DNA, 28 bp, Artificial Sequence
  TCRA J-segment Reverse Primer
tgcttggcttcacagttagtcatgtctc

SEQ ID NO: 328 - DNA, 26 bp, Artificial Sequence
  TCRA J-segment Reverse Primer
cttggatggacagtcaagatggtccc

SEQ ID NO: 329 - DNA, 32 bp, Artificial Sequence
  TCRA J-segment Reverse Primer
aacttacttggattcacggttaagagagttcc

SEQ ID NO: 330 - DNA, 25 bp, Artificial Sequence
  TCRA J-segment Reverse Primer
ttgggttgatagtcagcctggttcc

SEQ ID NO: 331 - DNA, 36 bp, Artificial Sequence
  TCRA J-segment Reverse Primer
ccacacttacttggatttatttttgtactcatcccc

SEQ ID NO: 332 - DNA, 35 bp, Artificial Sequence
  TCRA J-segment Reverse Primer
taaaacatacctggtctaacactcagagttattcc

SEQ ID NO: 333 - DNA, 28 bp, Artificial Sequence
  TCRA J-segment Reverse Primer
tacatgggtttactgtcagtttcgttcc

SEQ ID NO: 334 - DNA, 26 bp, Artificial Sequence
  TCRA J-segment Reverse Primer
ccaggattcactgtgagctgtgttcc

SEQ ID NO: 335 - DNA, 23 bp, Artificial Sequence
  TCRA J-segment Reverse Primer
agcttcactctcacttgcgtccc

SEQ ID NO: 336 - DNA, 26 bp, Artificial Sequence
  TCRA J-segment Reverse Primer
cccaggctcacaattaactcagtccc

SEQ ID NO: 337 - DNA, 32 bp, Artificial Sequence
  TCRA J-segment Reverse Primer
tacttgctgagtttcatgattcctctagtgtt

SEQ ID NO: 338 - DNA, 22 bp, Artificial Sequence
  TCRD J-segment Reverse Primer
gttccacagtcacacgggttcc

SEQ ID NO: 339 - DNA, 25 bp, Artificial Sequence
  TCRD J-segment Reverse Primer
ctggttccacgatgagttgtgttcc

SEQ ID NO: 340 - DNA, 23 bp, Artificial Sequence
  TCRD J-segment Reverse Primer
ggctccacgaagagtttgatgcc

SEQ ID NO: 341 - DNA, 30 bp, Artificial Sequence
  TCRD J-segment Reverse Primer
cttacgttgttgtacctccagataggttcc

SEQ ID NO: 342 - DNA, 48 bp, Artificial Sequence
  TCRA J-segment Reverse Primer With Universal Adaptor
ccgggagctgcatgtgtcagaggggggagaagtggaaactctggttcc

SEQ ID NO: 343 - DNA, 55 bp, Artificial Sequence
  TCRA J-segment Reverse Primer With Universal Adaptor
ccgggagctgcatgtgtcagagggactcaccagatataatgaatacatgggtccc

SEQ ID NO: 344 - DNA, 44 bp, Artificial Sequence
  TCRA J-segment Reverse Primer With Universal Adaptor
ccgggagctgcatgtgtcagaggccggatgctgagtctggtccc

SEQ ID NO: 345 - DNA, 43 bp, Artificial Sequence
  TCRA J-segment Reverse Primer With Universal Adaptor
ccgggagctgcatgtgtcagaggtgtacagccagcctggtccc

SEQ ID NO: 346 - DNA, 49 bp, Artificial Sequence
  TCRA J-segment Reverse Primer With Universal Adaptor
ccgggagctgcatgtgtcagaggcttggttgcacttggagtcttgttcc

SEQ ID NO: 347 - DNA, 49 bp, Artificial Sequence
  TCRA J-segment Reverse Primer With Universal Adaptor
ccgggagctgcatgtgtcagaggcacggatgaacaataaggctggttcc

SEQ ID NO: 348 - DNA, 48 bp, Artificial Sequence
  TCRA J-segment Reverse Primer With Universal Adaptor
ccgggagctgcatgtgtcagaggttggtatgaccaccacttggttccc

SEQ ID NO: 349 - DNA, 44 bp, Artificial Sequence
  TCRA J-segment Reverse Primer With Universal Adaptor
ccgggagctgcatgtgtcagaggactgaccagaagtcgggtgcc

SEQ ID NO: 350 - DNA, 59 bp, Artificial Sequence
  TCRA J-segment Reverse Primer With Universal Adaptor
ccgggagctgcatgtgtcagaggatggaacttacttgctttaacaaatagtcttgttcc

SEQ ID NO: 351 - DNA, 50 bp, Artificial Sequence
  TCRA J-segment Reverse Primer With Universal Adaptor
ccgggagctgcatgtgtcagaggactgagttccacttttagctgagtgcc

SEQ ID NO: 352 - DNA, 50 bp, Artificial Sequence
  TCRA J-segment Reverse Primer With Universal Adaptor
ccgggagctgcatgtgtcagaggacctggagagactagaagcatagtccc

SEQ ID NO: 353 - DNA, 44 bp, Artificial Sequence
  TCRA J-segment Reverse Primer With Universal Adaptor
ccgggagctgcatgtgtcagaggcctgaccagcagtctggtccc

SEQ ID NO: 354 - DNA, 49 bp, Artificial Sequence
  TCRA J-segment Reverse Primer With Universal Adaptor
ccgggagctgcatgtgtcagaggcttgggatgacttggagctttgttcc

SEQ ID NO: 355 - DNA, 57 bp, Artificial Sequence
  TCRA J-segment Reverse Primer With Universal Adaptor
ccgggagctgcatgtgtcagaggcctacttaccaggttttactgataatcttgtccc

SEQ ID NO: 356 - DNA, 53 bp, Artificial Sequence
  TCRA J-segment Reverse Primer With Universal Adaptor
ccgggagctgcatgtgtcagaggctggaactcactgataaggtggttcccttc

SEQ ID NO: 357 - DNA, 55 bp, Artificial Sequence
  TCRA J-segment Reverse Primer With Universal Adaptor
ccgggagctgcatgtgtcagaggtacttactaagatccacctttaacatggttcc

SEQ ID NO: 358 - DNA, 50 bp, Artificial Sequence
  TCRA J-segment Reverse Primer With Universal Adaptor
ccgggagctgcatgtgtcagaggacttggtttaactagcaccctggttcc

SEQ ID NO: 359 - DNA, 47 bp, Artificial Sequence
  TCRA J-segment Reverse Primer With Universal Adaptor
ccgggagctgcatgtgtcagaggaggccagacagtcaactgagttcc

SEQ ID NO: 360 - DNA, 57 bp, Artificial Sequence
  TCRA J-segment Reverse Primer With Universal Adaptor
ccgggagctgcatgtgtcagaggctcacttacttggagtgacattatgtttggatcc

SEQ ID NO: 361 - DNA, 55 bp, Artificial Sequence
  TCRA J-segment Reverse Primer With Universal Adaptor
ccgggagctgcatgtgtcagaggtacttacttgctcttacagttactgtggttcc

SEQ ID NO: 362 - DNA, 56 bp, Artificial Sequence
  TCRA J-segment Reverse Primer With Universal Adaptor
ccgggagctgcatgtgtcagaggtaacttacttggttttacattgagtttggtccc

SEQ ID NO: 363 - DNA, 51 bp, Artificial Sequence
  TCRA J-segment Reverse Primer With Universal Adaptor
ccgggagctgcatgtgtcagaggtaccaggtaaaacagtcaattgtgtccc

SEQ ID NO: 364 - DNA, 50 bp, Artificial Sequence
  TCRA J-segment Reverse Primer With Universal Adaptor
ccgggagctgcatgtgtcagaggactgggtttcacagataactccgttcc

SEQ ID NO: 365 - DNA, 44 bp, Artificial Sequence
  TCRA J-segment Reverse Primer With Universal Adaptor
ccgggagctgcatgtgtcagaggggtgaccacaacctgggtccc

SEQ ID NO: 366 - DNA, 45 bp, Artificial Sequence
  TCRA J-segment Reverse Primer With Universal Adaptor
ccgggagctgcatgtgtcagagggcttgacaagcagccttgtccc

SEQ ID NO: 367 - DNA, 45 bp, Artificial Sequence
  TCRA J-segment Reverse Primer With Universal Adaptor
ccgggagctgcatgtgtcagagggcagcacggacaatctggttcc

SEQ ID NO: 368 - DNA, 46 bp, Artificial Sequence
  TCRA J-segment Reverse Primer With Universal Adaptor
ccgggagctgcatgtgtcagaggggcttcacagtgagcgtagtccc

SEQ ID NO: 369 - DNA, 49 bp, Artificial Sequence
  TCRA J-segment Reverse Primer With Universal Adaptor
ccgggagctgcatgtgtcagaggcttggtatgaccgagagtttggtccc

SEQ ID NO: 370 - DNA, 50 bp, Artificial Sequence
  TCRA J-segment Reverse Primer With Universal Adaptor
ccgggagctgcatgtgtcagaggacttgcaatcacagaaagtcttgtgcc

SEQ ID NO: 371 - DNA, 49 bp, Artificial Sequence
  TCRA J-segment Reverse Primer With Universal Adaptor
ccgggagctgcatgtgtcagaggctggggagaatatgaagtcgtgtccc

SEQ ID NO: 372 - DNA, 45 bp, Artificial Sequence
  TCRA J-segment Reverse Primer With Universal Adaptor
ccgggagctgcatgtgtcagagggcttcaccaccagctgagttcc

SEQ ID NO: 373 - DNA, 44 bp, Artificial Sequence
  TCRA J-segment Reverse Primer With Universal Adaptor
ccgggagctgcatgtgtcagaggctggacagcaagcagagtgcc

SEQ ID NO: 374 - DNA, 55 bp, Artificial Sequence
  TCRA J-segment Reverse Primer With Universal Adaptor
ccgggagctgcatgtgtcagagggacttacctggctttataattagcttggtccc

SEQ ID NO: 375 - DNA, 55 bp, Artificial Sequence
  TCRA J-segment Reverse Primer With Universal Adaptor
ccgggagctgcatgtgtcagaggtacttacttggaaagacttgtaatctggtccc

SEQ ID NO: 376 - DNA, 53 bp, Artificial Sequence
  TCRA J-segment Reverse Primer With Universal Adaptor
ccgggagctgcatgtgtcagaggcttacgtggtaaaacaatcacttgagtgcc

SEQ ID NO: 377 - DNA, 48 bp, Artificial Sequence
  TCRA J-segment Reverse Primer With Universal Adaptor
ccgggagctgcatgtgtcagaggggggaataacggtgagtctcgttcc

SEQ ID NO: 378 - DNA, 54 bp, Artificial Sequence
  TCRA J-segment Reverse Primer With Universal Adaptor
ccgggagctgcatgtgtcagaggcctacctggttttacttggtaaagttgtccc

SEQ ID NO: 379 - DNA, 47 bp, Artificial Sequence
  TCRA J-segment Reverse Primer With Universal Adaptor
ccgggagctgcatgtgtcagaggcggatttactgccaggcttgttcc

SEQ ID NO: 380 - DNA, 49 bp, Artificial Sequence
  TCRA J-segment Reverse Primer With Universal Adaptor
ccgggagctgcatgtgtcagaggcggggtttgaccattaaccttgttcc

SEQ ID NO: 381 - DNA, 46 bp, Artificial Sequence
  TCRA J-segment Reverse Primer With Universal Adaptor
ccgggagctgcatgtgtcagagggctaaaaccttcagcctggtgcc

SEQ ID NO: 382 - DNA, 43 bp, Artificial Sequence
  TCRA J-segment Reverse Primer With Universal Adaptor
ccgggagctgcatgtgtcagagggtgaccaacagcgaggtgcc

SEQ ID NO: 383 - DNA, 56 bp, Artificial Sequence
  TCRA J-segment Reverse Primer With Universal Adaptor
ccgggagctgcatgtgtcagaggacacttacttggtttaacagagagtttagtgcc

SEQ ID NO: 384 - DNA, 50 bp, Artificial Sequence
  TCRA J-segment Reverse Primer With Universal Adaptor
ccgggagctgcatgtgtcagaggacttggttttactgtcagtctggtccc

SEQ ID NO: 385 - DNA, 48 bp, Artificial Sequence
  TCRA J-segment Reverse Primer With Universal Adaptor
ccgggagctgcatgtgtcagaggcgagcgtgacctgaagtcttgttcc

SEQ ID NO: 386 - DNA, 49 bp, Artificial Sequence
  TCRA J-segment Reverse Primer With Universal Adaptor
ccgggagctgcatgtgtcagaggcagggctggatgattagatgagtccc

SEQ ID NO: 387 - DNA, 47 bp, Artificial Sequence
  TCRA J-segment Reverse Primer With Universal Adaptor
ccgggagctgcatgtgtcagagggggcctaactgctaaacgagtccc

SEQ ID NO: 388 - DNA, 51 bp, Artificial Sequence
  TCRA J-segment Reverse Primer With Universal Adaptor
ccgggagctgcatgtgtcagaggcacaggacttgactctcagaatggttcc

SEQ ID NO: 389 - DNA, 50 bp, Artificial Sequence
  TCRA J-segment Reverse Primer With Universal Adaptor
ccgggagctgcatgtgtcagaggactgggtatgatggtgagtcttgttcc

SEQ ID NO: 390 - DNA, 49 bp, Artificial Sequence
  TCRA J-segment Reverse Primer With Universal Adaptor
ccgggagctgcatgtgtcagaggcttggaatgaccgtcaaacttgtccc

SEQ ID NO: 391 - DNA, 54 bp, Artificial Sequence
  TCRA J-segment Reverse Primer With Universal Adaptor
ccgggagctgcatgtgtcagaggacttacttggaatgactgataagcttgtccc

SEQ ID NO: 392 - DNA, 51 bp, Artificial Sequence
  TCRA J-segment Reverse Primer With Universal Adaptor
ccgggagctgcatgtgtcagaggtgcttggcttcacagttagtcatgtctc

SEQ ID NO: 393 - DNA, 49 bp, Artificial Sequence
  TCRA J-segment Reverse Primer With Universal Adaptor
ccgggagctgcatgtgtcagaggcttggatggacagtcaagatggtccc

SEQ ID NO: 394 - DNA, 55 bp, Artificial Sequence
  TCRA J-segment Reverse Primer With Universal Adaptor
ccgggagctgcatgtgtcagaggaacttacttggattcacggttaagagagttcc

SEQ ID NO: 395 - DNA, 48 bp, Artificial Sequence
  TCRA J-segment Reverse Primer With Universal Adaptor
ccgggagctgcatgtgtcagaggttgggttgatagtcagcctggttcc

SEQ ID NO: 396 - DNA, 59 bp, Artificial Sequence
  TCRA J-segment Reverse Primer With Universal Adaptor
ccgggagctgcatgtgtcagaggccacacttacttggatttatttttgtactcatcccc

SEQ ID NO: 397 - DNA, 58 bp, Artificial Sequence
  TCRA J-segment Reverse Primer With Universal Adaptor
ccgggagctgcatgtgtcagaggtaaaacatacctggtctaacactcagagttattcc

SEQ ID NO: 398 - DNA, 51 bp, Artificial Sequence
  TCRA J-segment Reverse Primer With Universal Adaptor
ccgggagctgcatgtgtcagaggtacatgggtttactgtcagtttcgttcc

SEQ ID NO: 399 - DNA, 49 bp, Artificial Sequence
  TCRA J-segment Reverse Primer With Universal Adaptor
ccgggagctgcatgtgtcagaggccaggattcactgtgagctgtgttcc

SEQ ID NO: 400 - DNA, 46 bp, Artificial Sequence
  TCRA J-segment Reverse Primer With Universal Adaptor
ccgggagctgcatgtgtcagaggagcttcactctcacttgcgtccc

SEQ ID NO: 401 - DNA, 49 bp, Artificial Sequence
  TCRA J-segment Reverse Primer With Universal Adaptor
ccgggagctgcatgtgtcagaggcccaggctcacaattaactcagtccc

SEQ ID NO: 402 - DNA, 55 bp, Artificial Sequence
  TCRA J-segment Reverse Primer With Universal Adaptor
ccgggagctgcatgtgtcagaggtacttgctgagtttcatgattcctctagtgtt

SEQ ID NO: 403 - DNA, 45 bp, Artificial Sequence
  TCRD J-segment Reverse Primer With Universal Adaptor
ccgggagctgcatgtgtcagagggttccacagtcacacgggttcc

SEQ ID NO: 404 - DNA, 48 bp, Artificial Sequence
  TCRD J-segment Reverse Primer With Universal Adaptor
ccgggagctgcatgtgtcagaggctggttccacgatgagttgtgttcc

SEQ ID NO: 405 - DNA, 46 bp, Artificial Sequence
  TCRD J-segment Reverse Primer With Universal Adaptor
ccgggagctgcatgtgtcagaggggctccacgaagagtttgatgcc

SEQ ID NO: 406 - DNA, 53 bp, Artificial Sequence
  TCRD J-segment Reverse Primer With Universal Adaptor
ccgggagctgcatgtgtcagaggcttacgttgttgtacctccagataggttcc

SEQ ID NO: 407 - DNA, 25 bp, Artificial Sequence
  IGH V-segment Forward Primer
ggcccctggacaagggcttgaaagg

SEQ ID NO: 408 - DNA, 24 bp, Artificial Sequence
  IGH V-segment Forward Primer
gctctcagggaggggctgcaatgg

SEQ ID NO: 409 - DNA, 28 bp, Artificial Sequence
  IGH V-segment Forward Primer
ccagatgcccgggaaagaactggagtgg

SEQ ID NO: 410 - DNA, 26 bp, Artificial Sequence
  IGH V-segment Forward Primer
aggctccagggaatgggctggagttg

SEQ ID NO: 411 - DNA, 29 bp, Artificial Sequence
  IGH V-segment Forward Primer
gccaggctccagggaagggactggaatat

SEQ ID NO: 412 - DNA, 24 bp, Artificial Sequence
  IGH V-segment Forward Primer
gggccctggacaagggcatagtgg

SEQ ID NO: 413 - DNA, 38 bp, Artificial Sequence
  IGH V-segment Forward Primer
cctggatccaccatctcccatcaaaaggtcttcagtgt

SEQ ID NO: 414 - DNA, 23 bp, Artificial Sequence
  IGH V-segment Forward Primer
ccccaggacaggggcttgagtgg

SEQ ID NO: 415 - DNA, 31 bp, Artificial Sequence
  IGH V-segment Forward Primer
tgtgacaaagccctggacaagggcatagtgg

SEQ ID NO: 416 - DNA, 33 bp, Artificial Sequence
  IGH V-segment Forward Primer
gtccagcaggattcatggcaagtgttggtgagg

SEQ ID NO: 417 - DNA, 26 bp, Artificial Sequence
  IGH V-segment Forward Primer
ccgccagtcctcagtcaagggagtgg

SEQ ID NO: 418 - DNA, 26 bp, Artificial Sequence
  IGH V-segment Forward Primer
cccctctctgggagggaatggagtgg

SEQ ID NO: 419 - DNA, 25 bp, Artificial Sequence
  IGH V-segment Forward Primer
ctccccagggaagggactggagtga

SEQ ID NO: 420 - DNA, 32 bp, Artificial Sequence
  IGH V-segment Forward Primer
ctgtaggcactggatggaaagcacaggagtgg

SEQ ID NO: 421 - DNA, 24 bp, Artificial Sequence
  IGH V-segment Forward Primer
cccccagggaagggaatggagtgg

SEQ ID NO: 422 - DNA, 24 bp, Artificial Sequence
  IGH V-segment Forward Primer
cccgtgggcaacaggctggaatgg

SEQ ID NO: 423 - DNA, 24 bp, Artificial Sequence
  IGH V-segment Forward Primer
ccccccaggaagggactggagtga

SEQ ID NO: 424 - DNA, 21 bp, Artificial Sequence
  IGH V-segment Forward Primer
ccggggaagggactggagcga

SEQ ID NO: 425 - DNA, 27 bp, Artificial Sequence
  IGH V-segment Forward Primer
caggcccatggacaagggcttgaggaa

SEQ ID NO: 426 - DNA, 27 bp, Artificial Sequence
  IGH V-segment Forward Primer
caggctccagggaacagactggagtgg

SEQ ID NO: 427 - DNA, 26 bp, Artificial Sequence
  IGH V-segment Forward Primer
agcccccagggaagaagctgaagtgg

SEQ ID NO: 428 - DNA, 31 bp, Artificial Sequence
  IGH V-segment Forward Primer
ccagcacgcttcacaacagggataggtgtgg

SEQ ID NO: 429 - DNA, 31 bp, Artificial Sequence
  IGH V-segment Forward Primer
ctgcttgcccctagaagatggacaggagtgg

SEQ ID NO: 430 - DNA, 33 bp, Artificial Sequence
  IGH V-segment Forward Primer
gtgtgacaggcccctggataagggtttgaatgg

SEQ ID NO: 431 - DNA, 25 bp, Artificial Sequence
  IGH V-segment Forward Primer
gcccccatgggaggtactggagtgg

SEQ ID NO: 432 - DNA, 31 bp, Artificial Sequence
  IGH V-segment Forward Primer
ccagcacgcttcacaacaggaattggtgtgg

SEQ ID NO: 433 - DNA, 30 bp, Artificial Sequence
  IGH V-segment Forward Primer
cgccaggctccaagaaagggtttgtagtgg

SEQ ID NO: 434 - DNA, 23 bp, Artificial Sequence
  IGH V-segment Forward Primer
ccgcaaggaagggactggagcga

SEQ ID NO: 435 - DNA, 28 bp, Artificial Sequence
  IGH V-segment Forward Primer
ccaggctccaggaaagggtttggagtgg

SEQ ID NO: 436 - DNA, 30 bp, Artificial Sequence
  IGH V-segment Forward Primer
cagcaggcttcacaacagggattgtggtgg

SEQ ID NO: 437 - DNA, 30 bp, Artificial Sequence
  IGH V-segment Forward Primer
cacgagtccacatgggaaggactggagtgg

SEQ ID NO: 438 - DNA, 24 bp, Artificial Sequence
  IGH V-segment Forward Primer
tctccaggcaaggggctggagtga

SEQ ID NO: 439 - DNA, 28 bp, Artificial Sequence
  IGH V-segment Forward Primer
ccgggcttcaagaaaggggctggaatgg

SEQ ID NO: 440 - DNA, 31 bp, Artificial Sequence
  IGH V-segment Forward Primer
caatgagactctagggaaggggctggaggga

SEQ ID NO: 441 - DNA, 24 bp, Artificial Sequence
  IGH V-segment Forward Primer
cactagcccgcttccatgggctgt

SEQ ID NO: 442 - DNA, 26 bp, Artificial Sequence
  IGH V-segment Forward Primer
aggcttcaggacaggggttggtgtgg

SEQ ID NO: 443 - DNA, 31 bp, Artificial Sequence
  IGH V-segment Forward Primer
ccgccaagctacaggaaaaggtctggagtgg

SEQ ID NO: 444 - DNA, 24 bp, Artificial Sequence
  IGH V-segment Forward Primer
gctccaggaaaggggctgcagtga

SEQ ID NO: 445 - DNA, 20 bp, Artificial Sequence
  IGH V-segment Forward Primer
ctgggaaggcgctggggcac

SEQ ID NO: 446 - DNA, 30 bp, Artificial Sequence
  IGH V-segment Forward Primer
tgatagacccctggacagggctttgagtgg

SEQ ID NO: 447 - DNA, 25 bp, Artificial Sequence
  IGH V-segment Forward Primer
ggctcgtggacaacgccttgagtgg

SEQ ID NO: 448 - DNA, 22 bp, Artificial Sequence
  IGH V-segment Forward Primer
cccagggaaggggctggagtgg

SEQ ID NO: 449 - DNA, 24 bp, Artificial Sequence
  IGH V-segment Forward Primer
gctccagggaaggggctggagtga

SEQ ID NO: 450 - DNA, 25 bp, Artificial Sequence
  IGH V-segment Forward Primer
ggcccatgcacaagggcttgagtgg

SEQ ID NO: 451 - DNA, 23 bp, Artificial Sequence
  IGH V-segment Forward Primer
ctgggggacagaggctggagtgg

SEQ ID NO: 452 - DNA, 23 bp, Artificial Sequence
  IGH V-segment Forward Primer
ccccagggaaggggctggaatgg

SEQ ID NO: 453 - DNA, 23 bp, Artificial Sequence
  IGH V-segment Forward Primer
ccccaggaaaggccctggagtgg

SEQ ID NO: 454 - DNA, 27 bp, Artificial Sequence
  IGH V-segment Forward Primer
cagtccccatcgagaggccttgagtgg

SEQ ID NO: 455 - DNA, 23 bp, Artificial Sequence
  IGH V-segment Forward Primer
ctgcaggcaaggggctggagtga

SEQ ID NO: 456 - DNA, 29 bp, Artificial Sequence
  IGH V-segment Forward Primer
gacaggctcctggaaaagggcttgagtgg

SEQ ID NO: 457 - DNA, 25 bp, Artificial Sequence
  IGH V-segment Forward Primer
ggccactggacaagggcttgagtgg

SEQ ID NO: 458 - DNA, 27 bp, Artificial Sequence
  IGH V-segment Forward Primer
caggcttctgggaaagggctggagtgg

SEQ ID NO: 459 - DNA, 25 bp, Artificial Sequence
  IGH V-segment Forward Primer
ggcccctggaaaagggcttgagtgg

SEQ ID NO: 460 - DNA, 24 bp, Artificial Sequence
  IGH V-segment Forward Primer
gcccccggacaaaggcttgagtgg

SEQ ID NO: 461 - DNA, 22 bp, Artificial Sequence
  IGH V-segment Forward Primer
cgccgggaagggactggagtgg

SEQ ID NO: 462 - DNA, 32 bp, Artificial Sequence
  IGH V-segment Forward Primer
tccagcaggcttcatgacagggatttgtgtgg

SEQ ID NO: 463 - DNA, 27 bp, Artificial Sequence
  IGH V-segment Forward Primer
cagtcccctggacaagggcttgagtgg

SEQ ID NO: 464 - DNA, 30 bp, Artificial Sequence
  IGH V-segment Forward Primer
cagcaggcttcatgacagggattggtgtgg

SEQ ID NO: 465 - DNA, 24 bp, Artificial Sequence
  IGH V-segment Forward Primer
gcctcagggaaggggctggaatgg

SEQ ID NO: 466 - DNA, 22 bp, Artificial Sequence
  IGH V-segment Forward Primer
tcccgggaaggggctggaatgg

SEQ ID NO: 467 - DNA, 24 bp, Artificial Sequence
  IGH V-segment Forward Primer
gcccctggacaagggcttgagtgg

SEQ ID NO: 468 - DNA, 23 bp, Artificial Sequence
  IGH V-segment Forward Primer
ctccggggaagggtctggagtgg

SEQ ID NO: 469 - DNA, 23 bp, Artificial Sequence
  IGH V-segment Forward Primer
ctccaggcaaggggctggagtgg

SEQ ID NO: 470 - DNA, 23 bp, Artificial Sequence
  IGH V-segment Forward Primer
cccccggacaagcgcttgagtgg

SEQ ID NO: 471 - DNA, 25 bp, Artificial Sequence
  IGH V-segment Forward Primer
gatgcccgggaaaggcttggagtgg

SEQ ID NO: 472 - DNA, 24 bp, Artificial Sequence
  IGH V-segment Forward Primer
gctccagggaagggtctgcagtgg

SEQ ID NO: 473 - DNA, 23 bp, Artificial Sequence
  IGH V-segment Forward Primer
ctccagggaaggggctggtgtgg

SEQ ID NO: 474 - DNA, 28 bp, Artificial Sequence
  IGH V-segment Forward Primer
gcaggcttcatgacaggggtgggtgtag

SEQ ID NO: 475 - DNA, 24 bp, Artificial Sequence
  IGH V-segment Forward Primer
gcttccgggaaagggctggagtgg

SEQ ID NO: 476 - DNA, 24 bp, Artificial Sequence
  IGH V-segment Forward Primer
gctggaggagaggggctggagtgg

SEQ ID NO: 477 - DNA, 30 bp, Artificial Sequence
  IGH V-segment Forward Primer
catcaggctcctgggaaagggctggagtag

SEQ ID NO: 478 - DNA, 20 bp, Artificial Sequence
  IGH V-segment Forward Primer
ccgggaaggggctggagtgg

SEQ ID NO: 479 - DNA, 23 bp, Artificial Sequence
  IGH V-segment Forward Primer
caccagggaagggcctggagtgg

SEQ ID NO: 480 - DNA, 23 bp, Artificial Sequence
  IGH V-segment Forward Primer
ctccggagaaggggctggagtgg

SEQ ID NO: 481 - DNA, 22 bp, Artificial Sequence
  IGH V-segment Forward Primer
cccagggaaggccctggagtgg

SEQ ID NO: 482 - DNA, 24 bp, Artificial Sequence
  IGH V-segment Forward Primer
ccctcagcaaaggccctggagtgg

SEQ ID NO: 483 - DNA, 27 bp, Artificial Sequence
  IGH V-segment Forward Primer
caagctccagggaagggactggagtgg

SEQ ID NO: 484 - DNA, 23 bp, Artificial Sequence
  IGH V-segment Forward Primer
ctccagggaaggggctggagtgg

SEQ ID NO: 485 - DNA, 23 bp, Artificial Sequence
  IGH V-segment Forward Primer
ctccagggaagggtccggagtgg

SEQ ID NO: 486 - DNA, 24 bp, Artificial Sequence
  IGH V-segment Forward Primer
gctccaggaaaggggctggagtgg

SEQ ID NO: 487 - DNA, 22 bp, Artificial Sequence
  IGH V-segment Forward Primer
cccagggaagggcctggagtgg

SEQ ID NO: 488 - DNA, 22 bp, Artificial Sequence
  IGH V-segment Forward Primer
gcccgggaaaggcctggagtgg

SEQ ID NO: 489 - DNA, 23 bp, Artificial Sequence
  IGH V-segment Forward Primer
ctccagggaagggcctggagtgg

SEQ ID NO: 490 - DNA, 26 bp, Artificial Sequence
  IGH V-segment Forward Primer
aggcttcatgacaggggtgggtgtgg

SEQ ID NO: 491 - DNA, 23 bp, Artificial Sequence
  IGH V-segment Forward Primer
ccccagggaagggactggagtgg

SEQ ID NO: 492 - DNA, 25 bp, Artificial Sequence
  IGH V-segment Forward Primer
ggctccagggaagggtctggagtgg

SEQ ID NO: 493 - DNA, 48 bp, Artificial Sequence
  IGH V-segment Forward Primer with Universal Adaptor
gggctggcaagccacgtttggtgggcccctggacaagggcttgaaagg

SEQ ID NO: 494 - DNA, 47 bp, Artificial Sequence
  IGH V-segment Forward Primer with Universal Adaptor
gggctggcaagccacgtttggtggctctcagggaggggctgcaatgg

SEQ ID NO: 495 - DNA, 51 bp, Artificial Sequence
  IGH V-segment Forward Primer with Universal Adaptor
gggctggcaagccacgtttggtgccagatgcccgggaaagaactggagtgg

SEQ ID NO: 496 - DNA, 49 bp, Artificial Sequence
  IGH V-segment Forward Primer with Universal Adaptor
gggctggcaagccacgtttggtgaggctccagggaatgggctggagttg

SEQ ID NO: 497 - DNA, 52 bp, Artificial Sequence
  IGH V-segment Forward Primer with Universal Adaptor
gggctggcaagccacgtttggtggccaggctccagggaagggactggaatat

SEQ ID NO: 498 - DNA, 47 bp, Artificial Sequence
  IGH V-segment Forward Primer with Universal Adaptor
gggctggcaagccacgtttggtggggccctggacaagggcatagtgg

SEQ ID NO: 499 - DNA, 61 bp, Artificial Sequence
  IGH V-segment Forward Primer with Universal Adaptor
gggctggcaagccacgtttggtgcctggatccaccatctcccatcaaaaggtcttcagtgt

SEQ ID NO: 500 - DNA, 46 bp, Artificial Sequence
  IGH V-segment Forward Primer with Universal Adaptor
gggctggcaagccacgtttggtgccccaggacaggggcttgagtgg

SEQ ID NO: 501 - DNA, 54 bp, Artificial Sequence
  IGH V-segment Forward Primer with Universal Adaptor
gggctggcaagccacgtttggtgtgtgacaaagccctggacaagggcatagtgg

SEQ ID NO: 502 - DNA, 56 bp, Artificial Sequence
  IGH V-segment Forward Primer with Universal Adaptor
gggctggcaagccacgtttggtggtccagcaggattcatggcaagtgttggtgagg

SEQ ID NO: 503 - DNA, 49 bp, Artificial Sequence
  IGH V-segment Forward Primer with Universal Adaptor
gggctggcaagccacgtttggtgccgccagtcctcagtcaagggagtgg

SEQ ID NO: 504 - DNA, 49 bp, Artificial Sequence
  IGH V-segment Forward Primer with Universal Adaptor
gggctggcaagccacgtttggtgcccctctctgggagggaatggagtgg

SEQ ID NO: 505 - DNA, 48 bp, Artificial Sequence
  IGH V-segment Forward Primer with Universal Adaptor
gggctggcaagccacgtttggtgctccccagggaagggactggagtga

SEQ ID NO: 506 - DNA, 55 bp, Artificial Sequence
  IGH V-segment Forward Primer with Universal Adaptor
gggctggcaagccacgtttggtgctgtaggcactggatggaaagcacaggagtgg

SEQ ID NO: 507 - DNA, 47 bp, Artificial Sequence
  IGH V-segment Forward Primer with Universal Adaptor
gggctggcaagccacgtttggtgcccccagggaagggaatggagtgg

SEQ ID NO: 508 - DNA, 47 bp, Artificial Sequence
  IGH V-segment Forward Primer with Universal Adaptor
gggctggcaagccacgtttggtgcccgtgggcaacaggctggaatgg

SEQ ID NO: 509 - DNA, 47 bp, Artificial Sequence
  IGH V-segment Forward Primer with Universal Adaptor
gggctggcaagccacgtttggtgccccccaggaagggactggagtga

SEQ ID NO: 510 - DNA, 44 bp, Artificial Sequence
  IGH V-segment Forward Primer with Universal Adaptor
gggctggcaagccacgtttggtgccggggaagggactggagcga

SEQ ID NO: 511 - DNA, 50 bp, Artificial Sequence
  IGH V-segment Forward Primer with Universal Adaptor
gggctggcaagccacgtttggtgcaggcccatggacaagggcttgaggaa

SEQ ID NO: 512 - DNA, 50 bp, Artificial Sequence
  IGH V-segment Forward Primer with Universal Adaptor
gggctggcaagccacgtttggtgcaggctccagggaacagactggagtgg

SEQ ID NO: 513 - DNA, 49 bp, Artificial Sequence
  IGH V-segment Forward Primer with Universal Adaptor
gggctggcaagccacgtttggtgagcccccagggaagaagctgaagtgg

SEQ ID NO: 514 - DNA, 54 bp, Artificial Sequence
  IGH V-segment Forward Primer with Universal Adaptor
gggctggcaagccacgtttggtgccagcacgcttcacaacagggataggtgtgg

SEQ ID NO: 515 - DNA, 54 bp, Artificial Sequence
  IGH V-segment Forward Primer with Universal Adaptor
gggctggcaagccacgtttggtgctgcttgcccctagaagatggacaggagtgg

SEQ ID NO: 516 - DNA, 56 bp, Artificial Sequence
  IGH V-segment Forward Primer with Universal Adaptor
gggctggcaagccacgtttggtggtgtgacaggcccctggataagggtttgaatgg

SEQ ID NO: 517 - DNA, 48 bp, Artificial Sequence
  IGH V-segment Forward Primer with Universal Adaptor
gggctggcaagccacgtttggtggcccccatgggaggtactggagtgg

SEQ ID NO: 518 - DNA, 54 bp, Artificial Sequence
  IGH V-segment Forward Primer with Universal Adaptor
gggctggcaagccacgtttggtgccagcacgcttcacaacaggaattggtgtgg

SEQ ID NO: 519 - DNA, 53 bp, Artificial Sequence
  IGH V-segment Forward Primer with Universal Adaptor
gggctggcaagccacgtttggtgcgccaggctccaagaaagggtttgtagtgg

SEQ ID NO: 520 - DNA, 46 bp, Artificial Sequence
  IGH V-segment Forward Primer with Universal Adaptor
gggctggcaagccacgtttggtgccgcaaggaagggactggagcga

SEQ ID NO: 521 - DNA, 51 bp, Artificial Sequence
  IGH V-segment Forward Primer with Universal Adaptor
gggctggcaagccacgtttggtgccaggctccaggaaagggtttggagtgg

SEQ ID NO: 522 - DNA, 53 bp, Artificial Sequence
  IGH V-segment Forward Primer with Universal Adaptor
gggctggcaagccacgtttggtgcagcaggcttcacaacagggattgtggtgg

SEQ ID NO: 523 - DNA, 53 bp, Artificial Sequence
  IGH V-segment Forward Primer with Universal Adaptor
gggctggcaagccacgtttggtgcacgagtccacatgggaaggactggagtgg

SEQ ID NO: 524 - DNA, 47 bp, Artificial Sequence
  IGH V-segment Forward Primer with Universal Adaptor
gggctggcaagccacgtttggtgtctccaggcaaggggctggagtga

SEQ ID NO: 525 - DNA, 51 bp, Artificial Sequence
  IGH V-segment Forward Primer with Universal Adaptor
gggctggcaagccacgtttggtgccgggcttcaagaaaggggctggaatgg

SEQ ID NO: 526 - DNA, 54 bp, Artificial Sequence
  IGH V-segment Forward Primer with Universal Adaptor
gggctggcaagccacgtttggtgcaatgagactctagggaaggggctggaggga

SEQ ID NO: 527 - DNA, 47 bp, Artificial Sequence
  IGH V-segment Forward Primer with Universal Adaptor
gggctggcaagccacgtttggtgcactagcccgcttccatgggctgt

SEQ ID NO: 528 - DNA, 49 bp, Artificial Sequence
  IGH V-segment Forward Primer with Universal Adaptor
gggctggcaagccacgtttggtgaggcttcaggacaggggttggtgtgg

SEQ ID NO: 529 - DNA, 54 bp, Artificial Sequence
  IGH V-segment Forward Primer with Universal Adaptor
gggctggcaagccacgtttggtgccgccaagctacaggaaaaggtctggagtgg

SEQ ID NO: 530 - DNA, 47 bp, Artificial Sequence
  IGH V-segment Forward Primer with Universal Adaptor
gggctggcaagccacgtttggtggctccaggaaaggggctgcagtga

SEQ ID NO: 531 - DNA, 43 bp, Artificial Sequence
  IGH V-segment Forward Primer with Universal Adaptor
gggctggcaagccacgtttggtgctgggaaggcgctggggcac

SEQ ID NO: 532 - DNA, 53 bp, Artificial Sequence
  IGH V-segment Forward Primer with Universal Adaptor
gggctggcaagccacgtttggtgtgatagacccctggacagggctttgagtgg

SEQ ID NO: 533 - DNA, 48 bp, Artificial Sequence
  IGH V-segment Forward Primer with Universal Adaptor
gggctggcaagccacgtttggtgggctcgtggacaacgccttgagtgg

SEQ ID NO: 534 - DNA, 45 bp, Artificial Sequence
  IGH V-segment Forward Primer with Universal Adaptor
gggctggcaagccacgtttggtgcccagggaaggggctggagtgg

SEQ ID NO: 535 - DNA, 47 bp, Artificial Sequence
  IGH V-segment Forward Primer with Universal Adaptor
gggctggcaagccacgtttggtggctccagggaaggggctggagtga

SEQ ID NO: 536 - DNA, 48 bp, Artificial Sequence
  IGH V-segment Forward Primer with Universal Adaptor
gggctggcaagccacgtttggtgggcccatgcacaagggcttgagtgg

SEQ ID NO: 537 - DNA, 46 bp, Artificial Sequence
  IGH V-segment Forward Primer with Universal Adaptor
gggctggcaagccacgtttggtgctgggggacagaggctggagtgg

SEQ ID NO: 538 - DNA, 46 bp, Artificial Sequence
  IGH V-segment Forward Primer with Universal Adaptor
gggctggcaagccacgtttggtgccccagggaaggggctggaatgg

SEQ ID NO: 539 - DNA, 46 bp, Artificial Sequence
  IGH V-segment Forward Primer with Universal Adaptor
gggctggcaagccacgtttggtgccccaggaaaggccctggagtgg

SEQ ID NO: 540 - DNA, 50 bp, Artificial Sequence
  IGH V-segment Forward Primer with Universal Adaptor
gggctggcaagccacgtttggtgcagtccccatcgagaggccttgagtgg

SEQ ID NO: 541 - DNA, 46 bp, Artificial Sequence
  IGH V-segment Forward Primer with Universal Adaptor
gggctggcaagccacgtttggtgctgcaggcaaggggctggagtga

SEQ ID NO: 542 - DNA, 52 bp, Artificial Sequence
  IGH V-segment Forward Primer with Universal Adaptor
gggctggcaagccacgtttggtggacaggctcctggaaaagggcttgagtgg

SEQ ID NO: 543 - DNA, 48 bp, Artificial Sequence
  IGH V-segment Forward Primer with Universal Adaptor
gggctggcaagccacgtttggtgggccactggacaagggcttgagtgg

SEQ ID NO: 544 - DNA, 50 bp, Artificial Sequence
  IGH V-segment Forward Primer with Universal Adaptor
gggctggcaagccacgtttggtgcaggcttctgggaaagggctggagtgg

SEQ ID NO: 545 - DNA, 48 bp, Artificial Sequence
  IGH V-segment Forward Primer with Universal Adaptor
gggctggcaagccacgtttggtgggcccctggaaaagggcttgagtgg

SEQ ID NO: 546 - DNA, 47 bp, Artificial Sequence
  IGH V-segment Forward Primer with Universal Adaptor
gggctggcaagccacgtttggtggcccccggacaaaggcttgagtgg

SEQ ID NO: 547 - DNA, 45 bp, Artificial Sequence
  IGH V-segment Forward Primer with Universal Adaptor
gggctggcaagccacgtttggtgcgccgggaagggactggagtgg

SEQ ID NO: 548 - DNA, 55 bp, Artificial Sequence
  IGH V-segment Forward Primer with Universal Adaptor
gggctggcaagccacgtttggtgtccagcaggcttcatgacagggatttgtgtgg

SEQ ID NO: 549 - DNA, 50 bp, Artificial Sequence
  IGH V-segment Forward Primer with Universal Adaptor
gggctggcaagccacgtttggtgcagtcccctggacaagggcttgagtgg

SEQ ID NO: 550 - DNA, 53 bp, Artificial Sequence
  IGH V-segment Forward Primer with Universal Adaptor
gggctggcaagccacgtttggtgcagcaggcttcatgacagggattggtgtgg

SEQ ID NO: 551 - DNA, 47 bp, Artificial Sequence
  IGH V-segment Forward Primer with Universal Adaptor
gggctggcaagccacgtttggtggcctcagggaaggggctggaatgg

SEQ ID NO: 552 - DNA, 45 bp, Artificial Sequence
  IGH V-segment Forward Primer with Universal Adaptor
gggctggcaagccacgtttggtgtcccgggaaggggctggaatgg

SEQ ID NO: 553 - DNA, 47 bp, Artificial Sequence
  IGH V-segment Forward Primer with Universal Adaptor
gggctggcaagccacgtttggtggcccctggacaagggcttgagtgg

SEQ ID NO: 554 - DNA, 46 bp, Artificial Sequence
  IGH V-segment Forward Primer with Universal Adaptor
gggctggcaagccacgtttggtgctccggggaagggtctggagtgg

SEQ ID NO: 555 - DNA, 46 bp, Artificial Sequence
  IGH V-segment Forward Primer with Universal Adaptor
gggctggcaagccacgtttggtgctccaggcaaggggctggagtgg

SEQ ID NO: 556 - DNA, 46 bp, Artificial Sequence
  IGH V-segment Forward Primer with Universal Adaptor
gggctggcaagccacgtttggtgcccccggacaagcgcttgagtgg

SEQ ID NO: 557 - DNA, 48 bp, Artificial Sequence
  IGH V-segment Forward Primer with Universal Adaptor
gggctggcaagccacgtttggtggatgcccgggaaaggcttggagtgg

SEQ ID NO: 558 - DNA, 47 bp, Artificial Sequence
  IGH V-segment Forward Primer with Universal Adaptor
gggctggcaagccacgtttggtggctccagggaagggtctgcagtgg

SEQ ID NO: 559 - DNA, 46 bp, Artificial Sequence
  IGH V-segment Forward Primer with Universal Adaptor
gggctggcaagccacgtttggtgctccagggaaggggctggtgtgg

SEQ ID NO: 560 - DNA, 51 bp, Artificial Sequence
  IGH V-segment Forward Primer with Universal Adaptor
gggctggcaagccacgtttggtggcaggcttcatgacaggggtgggtgtag

SEQ ID NO: 561 - DNA, 47 bp, Artificial Sequence
  IGH V-segment Forward Primer with Universal Adaptor
gggctggcaagccacgtttggtggcttccgggaaagggctggagtgg

SEQ ID NO: 562 - DNA, 47 bp, Artificial Sequence
  IGH V-segment Forward Primer with Universal Adaptor
gggctggcaagccacgtttggtggctggaggagaggggctggagtgg

SEQ ID NO: 563 - DNA, 53 bp, Artificial Sequence
  IGH V-segment Forward Primer with Universal Adaptor
gggctggcaagccacgtttggtgcatcaggctcctgggaaagggctggagtag

SEQ ID NO: 564 - DNA, 43 bp, Artificial Sequence
  IGH V-segment Forward Primer with Universal Adaptor
gggctggcaagccacgtttggtgccgggaaggggctggagtgg

SEQ ID NO: 565 - DNA, 46 bp, Artificial Sequence
  IGH V-segment Forward Primer with Universal Adaptor
gggctggcaagccacgtttggtgcaccagggaagggcctggagtgg

SEQ ID NO: 566 - DNA, 46 bp, Artificial Sequence
  IGH V-segment Forward Primer with Universal Adaptor
gggctggcaagccacgtttggtgctccggagaaggggctggagtgg

SEQ ID NO: 567 - DNA, 45 bp, Artificial Sequence
  IGH V-segment Forward Primer with Universal Adaptor
gggctggcaagccacgtttggtgcccagggaaggccctggagtgg

SEQ ID NO: 568 - DNA, 47 bp, Artificial Sequence
  IGH V-segment Forward Primer with Universal Adaptor
gggctggcaagccacgtttggtgccctcagcaaaggccctggagtgg

SEQ ID NO: 569 - DNA, 50 bp, Artificial Sequence
  IGH V-segment Forward Primer with Universal Adaptor
gggctggcaagccacgtttggtgcaagctccagggaagggactggagtgg

SEQ ID NO: 570 - DNA, 46 bp, Artificial Sequence
  IGH V-segment Forward Primer with Universal Adaptor
gggctggcaagccacgtttggtgctccagggaaggggctggagtgg

SEQ ID NO: 571 - DNA, 46 bp, Artificial Sequence
  IGH V-segment Forward Primer with Universal Adaptor
gggctggcaagccacgtttggtgctccagggaagggtccggagtgg

SEQ ID NO: 572 - DNA, 47 bp, Artificial Sequence
  IGH V-segment Forward Primer with Universal Adaptor
gggctggcaagccacgtttggtggctccaggaaaggggctggagtgg

SEQ ID NO: 573 - DNA, 45 bp, Artificial Sequence
  IGH V-segment Forward Primer with Universal Adaptor
gggctggcaagccacgtttggtgcccagggaagggcctggagtgg

SEQ ID NO: 574 - DNA, 45 bp, Artificial Sequence
  IGH V-segment Forward Primer with Universal Adaptor
gggctggcaagccacgtttggtggcccgggaaaggcctggagtgg

SEQ ID NO: 575 - DNA, 46 bp, Artificial Sequence
  IGH V-segment Forward Primer with Universal Adaptor
gggctggcaagccacgtttggtgctccagggaagggcctggagtgg

SEQ ID NO: 576 - DNA, 49 bp, Artificial Sequence
  IGH V-segment Forward Primer with Universal Adaptor
gggctggcaagccacgtttggtgaggcttcatgacaggggtgggtgtgg

SEQ ID NO: 577 - DNA, 46 bp, Artificial Sequence
  IGH V-segment Forward Primer with Universal Adaptor
gggctggcaagccacgtttggtgccccagggaagggactggagtgg

SEQ ID NO: 578 - DNA, 48 bp, Artificial Sequence
  IGH V-segment Forward Primer with Universal Adaptor
gggctggcaagccacgtttggtgggctccagggaagggtctggagtgg

SEQ ID NO: 579 - DNA, 25 bp, Artificial Sequence
  IGH J-segment Reverse Primer
cacctgaggagacggtgaccagggt

SEQ ID NO: 580 - DNA, 28 bp, Artificial Sequence
  IGH J-segment Reverse Primer
actcacctgaggagacagtgaccagggt

SEQ ID NO: 581 - DNA, 37 bp, Artificial Sequence
  IGH J-segment Reverse Primer
ggaaagccatcttacctgaagagacggtgaccattgt

SEQ ID NO: 582 - DNA, 28 bp, Artificial Sequence
  IGH J-segment Reverse Primer
tcttacctgaggagacggtgaccgtggt

SEQ ID NO: 583 - DNA, 20 bp, Artificial Sequence
  IGH J-segment Reverse Primer
gtggctgcggtctccagggc

SEQ ID NO: 584 - DNA, 18 bp, Artificial Sequence
  IGH J-segment Reverse Primer
ggagacggtggccgggct

SEQ ID NO: 585 - DNA, 24 bp, Artificial Sequence
  IGH J-segment Reverse Primer
gcctgacccctcagaagccagacc

SEQ ID NO: 586 - DNA, 48 bp, Artificial Sequence
  IGH J-segment Reverse Primer with Universal Adaptor
ccgggagctgcatgtgtcagaggcacctgaggagacggtgaccagggt

SEQ ID NO: 587 - DNA, 51 bp, Artificial Sequence
  IGH J-segment Reverse Primer with Universal Adaptor
ccgggagctgcatgtgtcagaggactcacctgaggagacagtgaccagggt

SEQ ID NO: 588 - DNA, 60 bp, Artificial Sequence
  IGH J-segment Reverse Primer with Universal Adaptor
ccgggagctgcatgtgtcagaggggaaagccatcttacctgaagagacggtgaccattgt

SEQ ID NO: 589 - DNA, 51 bp, Artificial Sequence
  IGH J-segment Reverse Primer with Universal Adaptor
ccgggagctgcatgtgtcagaggtcttacctgaggagacggtgaccgtggt

SEQ ID NO: 590 - DNA, 43 bp, Artificial Sequence
  IGH J-segment Reverse Primer with Universal Adaptor
ccgggagctgcatgtgtcagagggtggctgcggtctccagggc

SEQ ID NO: 591 - DNA, 41 bp, Artificial Sequence
  IGH J-segment Reverse Primer with Universal Adaptor
ccgggagctgcatgtgtcagaggggagacggtggccgggct

SEQ ID NO: 592 - DNA, 47 bp, Artificial Sequence
  IGH J-segment Reverse Primer with Universal Adaptor
ccgggagctgcatgtgtcagagggcctgacccctcagaagccagacc

SEQ ID NO: 593 - DNA, 35 bp, Artificial Sequence
  IGK V-segment Forward Primer
tctgcatctgtaggagacagagtcaccatcacttg

SEQ ID NO: 594 - DNA, 35 bp, Artificial Sequence
  IGK V-segment Forward Primer
tctgcatctacaggagacagagtcaccatcacttg

SEQ ID NO: 595 - DNA, 35 bp, Artificial Sequence
  IGK V-segment Forward Primer
ctgcatctgtaaggagacagtgtcaccatcacttg

SEQ ID NO: 596 - DNA, 35 bp, Artificial Sequence
  IGK V-segment Forward Primer
tctgcatctacaggagacagagtcaccatcagttg

SEQ ID NO: 597 - DNA, 35 bp, Artificial Sequence
  IGK V-segment Forward Primer
actgcatctgtaggagagagagtcaccatcacttg

SEQ ID NO: 598 - DNA, 33 bp, Artificial Sequence
  IGK V-segment Forward Primer
gcatctgtaaggagacagcgtcaccatcacttg

SEQ ID NO: 599 - DNA, 36 bp, Artificial Sequence
  IGK V-segment Forward Primer
gtctgcatctgtaggagacagagtcagtatcatttg

SEQ ID NO: 600 - DNA, 23 bp, Artificial Sequence
  IGK V-segment Forward Primer
ggagagccggcctccatctcctg

SEQ ID NO: 601 - DNA, 26 bp, Artificial Sequence
  IGK V-segment Forward Primer
cctggagagccagcctccatctcctg

SEQ ID NO: 602 - DNA, 25 bp, Artificial Sequence
  IGK V-segment Forward Primer
ctggagagccggcctccatctcttg

SEQ ID NO: 603 - DNA, 31 bp, Artificial Sequence
  IGK V-segment Forward Primer
tcttccttggagagccatcctccatttcctg

SEQ ID NO: 604 - DNA, 23 bp, Artificial Sequence
  IGK V-segment Forward Primer
ggacagccggcctccatctcctg

SEQ ID NO: 605 - DNA, 24 bp, Artificial Sequence
  IGK V-segment Forward Primer
tggagagccggcctccatctcctg

SEQ ID NO: 606 - DNA, 36 bp, Artificial Sequence
  IGK V-segment Forward Primer
ataatatttgtacataactttgtacttcatctcctg

SEQ ID NO: 607 - DNA, 28 bp, Artificial Sequence
  IGK V-segment Forward Primer
cccctggaaagccagcctctatctcctg

SEQ ID NO: 608 - DNA, 32 bp, Artificial Sequence
  IGK V-segment Forward Primer
ctcttccttggagagccatcctccatttcctg

SEQ ID NO: 609 - DNA, 23 bp, Artificial Sequence
  IGK V-segment Forward Primer
ggacagccggcctccatctcctt

SEQ ID NO: 610 - DNA, 26 bp, Artificial Sequence
  IGK V-segment Forward Primer
cctggagagcaggcctccatgtcctg

SEQ ID NO: 611 - DNA, 26 bp, Artificial Sequence
  IGK V-segment Forward Primer
ccaggggaaagagccaccctctcctg

SEQ ID NO: 612 - DNA, 27 bp, Artificial Sequence
  IGK V-segment Forward Primer
tccaggggaaagagtcaccctctcctg

SEQ ID NO: 613 - DNA, 35 bp, Artificial Sequence
  IGK V-segment Forward Primer
tctttgtctctggagaaaaaagccaccctgacttg

SEQ ID NO: 614 - DNA, 29 bp, Artificial Sequence
  IGK V-segment Forward Primer
tctctaggggaaaaagccaccctcaccta

SEQ ID NO: 615 - DNA, 23 bp, Artificial Sequence
  IGK V-segment Forward Primer
ggggaaggagccaccctcacctg

SEQ ID NO: 616 - DNA, 24 bp, Artificial Sequence
  IGK V-segment Forward Primer
gggcgagagggccaccatcaactg

SEQ ID NO: 617 - DNA, 32 bp, Artificial Sequence
  IGK V-segment Forward Primer
gcgactccaggagacaaagtcaacatctcctg

SEQ ID NO: 618 - DNA, 34 bp, Artificial Sequence
  IGK V-segment Forward Primer
ctgtgactccaaaggagaaagtcaccatcacctg

SEQ ID NO: 619 - DNA, 29 bp, Artificial Sequence
  IGK V-segment Forward Primer
actccaggggagaaagtcaccatcacctg

SEQ ID NO: 620 - DNA, 25 bp, Artificial Sequence
  IGK V-segment Forward Primer
caggacagagggccaccatcacctg

SEQ ID NO: 621 - DNA, 26 bp, Artificial Sequence
  IGL V-segment Forward Primer
cccaggcagagggtcaccatctcctg

SEQ ID NO: 622 - DNA, 26 bp, Artificial Sequence
  IGL V-segment Forward Primer
ccagggcagagggtcaccatctcctg

SEQ ID NO: 623 - DNA, 25 bp, Artificial Sequence
  IGL V-segment Forward Primer
ccgggcagagggtcaccatctcttg

SEQ ID NO: 624 - DNA, 28 bp, Artificial Sequence
  IGL V-segment Forward Primer
ccccaggacagaaggtcaccatctcctg

SEQ ID NO: 625 - DNA, 28 bp, Artificial Sequence
  IGL V-segment Forward Primer
ccacaaggcagaggctcactgtctcctg

SEQ ID NO: 626 - DNA, 30 bp, Artificial Sequence
  IGL V-segment Forward Primer
gtctcctggacagtcagtcaccatctcctg

SEQ ID NO: 627 - DNA, 30 bp, Artificial Sequence
  IGL V-segment Forward Primer
gtctcctggacagtcgatcaccatctcctg

SEQ ID NO: 628 - DNA, 27 bp, Artificial Sequence
  IGL V-segment Forward Primer
tcctggacagtcggtcaccatctcctg

SEQ ID NO: 629 - DNA, 33 bp, Artificial Sequence
  IGL V-segment Forward Primer
ctgggacttggggtaaacagtcaccatcttctg

SEQ ID NO: 630 - DNA, 26 bp, Artificial Sequence
  IGL V-segment Forward Primer
ccaggacagacagccagcatcacctg

SEQ ID NO: 631 - DNA, 28 bp, Artificial Sequence
  IGL V-segment Forward Primer
ctttgggacgtacggccaggatcatctg

SEQ ID NO: 632 - DNA, 28 bp, Artificial Sequence
  IGL V-segment Forward Primer
ctttgggacagatggccaggatcacctg

SEQ ID NO: 633 - DNA, 26 bp, Artificial Sequence
  IGL V-segment Forward Primer
ccaggacaggcagccatgatcacctg

SEQ ID NO: 634 - DNA, 25 bp, Artificial Sequence
  IGL V-segment Forward Primer
tgggacagagggccaggatcaccta

SEQ ID NO: 635 - DNA, 24 bp, Artificial Sequence
  IGL V-segment Forward Primer
gggacaggcggccaggattacctg

SEQ ID NO: 636 - DNA, 26 bp, Artificial Sequence
  IGL V-segment Forward Primer
ccaggacaaacggccaggatcacctg

SEQ ID NO: 637 - DNA, 27 bp, Artificial Sequence
  IGL V-segment Forward Primer
cacagcacagatggccaggatcacctg

SEQ ID NO: 638 - DNA, 26 bp, Artificial Sequence
  IGL V-segment Forward Primer
ccaggacagacagccaggatcagctg

SEQ ID NO: 639 - DNA, 28 bp, Artificial Sequence
  IGL V-segment Forward Primer
ccccaggacagatgaccaggatcacctg

SEQ ID NO: 640 - DNA, 28 bp, Artificial Sequence
  IGL V-segment Forward Primer
ccctaggacagatggccaggatcacctg

SEQ ID NO: 641 - DNA, 31 bp, Artificial Sequence
  IGL V-segment Forward Primer
gtgtctgtggacagtcagcaagggtaacctg

SEQ ID NO: 642 - DNA, 30 bp, Artificial Sequence
  IGL V-segment Forward Primer
ggccttgggacagacagtcaggatcacatg

SEQ ID NO: 643 - DNA, 28 bp, Artificial Sequence
  IGL V-segment Forward Primer
ccccaggaaagacggccaggattacctg

SEQ ID NO: 644 - DNA, 27 bp, Artificial Sequence
  IGL V-segment Forward Primer
cccaggacagaaagccaggatcacctg

SEQ ID NO: 645 - DNA, 34 bp, Artificial Sequence
  IGL V-segment Forward Primer
cagtagctccaggacagatgactaggatcacctg

SEQ ID NO: 646 - DNA, 25 bp, Artificial Sequence
  IGL V-segment Forward Primer
caggacagacggccaggatcacctg

SEQ ID NO: 647 - DNA, 27 bp, Artificial Sequence
  IGL V-segment Forward Primer
cctgggacagtcagccagggtaacctg

SEQ ID NO: 648 - DNA, 25 bp, Artificial Sequence
  IGL V-segment Forward Primer
cgggacagacagccaggatcacctg

SEQ ID NO: 649 - DNA, 27 bp, Artificial Sequence
  IGL V-segment Forward Primer
cccaggacagacacccaggatcacctg

SEQ ID NO: 650 - DNA, 28 bp, Artificial Sequence
  IGL V-segment Forward Primer
ccccattacagatggccaggatcacctg

SEQ ID NO: 651 - DNA, 29 bp, Artificial Sequence
  IGL V-segment Forward Primer
gccttgggatagacagccaggatcacctg

SEQ ID NO: 652 - DNA, 28 bp, Artificial Sequence
  IGL V-segment Forward Primer
ccttgggacaaatggccaggatcacctg

SEQ ID NO: 653 - DNA, 26 bp, Artificial Sequence
  IGL V-segment Forward Primer
ctgggagcctcgatcaagctcacctg

SEQ ID NO: 654 - DNA, 27 bp, Artificial Sequence
  IGL V-segment Forward Primer
cctgggatcctcggtcaagctcacctg

SEQ ID NO: 655 - DNA, 24 bp, Artificial Sequence
  IGL V-segment Forward Primer
gggagcctcggtcaagctcacctg

SEQ ID NO: 656 - DNA, 27 bp, Artificial Sequence
  IGL V-segment Forward Primer
tcctggagaatccgccagactcacctg

SEQ ID NO: 657 - DNA, 29 bp, Artificial Sequence
  IGL V-segment Forward Primer
tctcctggagcatcagccagattcacctg

SEQ ID NO: 658 - DNA, 27 bp, Artificial Sequence
  IGL V-segment Forward Primer
tcctggagcatcagccagtctcacctg

SEQ ID NO: 659 - DNA, 27 bp, Artificial Sequence
  IGL V-segment Forward Primer
tcctggagcatcagccagactcacctg

SEQ ID NO: 660 - DNA, 32 bp, Artificial Sequence
  IGL V-segment Forward Primer
gcatcttctggagcatcagtcagactcacctg

SEQ ID NO: 661 - DNA, 27 bp, Artificial Sequence
  IGL V-segment Forward Primer
cccaggagggacagtcactctcaccta

SEQ ID NO: 662 - DNA, 27 bp, Artificial Sequence
  IGL V-segment Forward Primer
cccaggagggacagtcactctcacctg

SEQ ID NO: 663 - DNA, 28 bp, Artificial Sequence
  IGL V-segment Forward Primer
cccctggagggacagtcacactcacttg

SEQ ID NO: 664 - DNA, 25 bp, Artificial Sequence
  IGL V-segment Forward Primer
tgggagcctcggtcacactcacctg

SEQ ID NO: 665 - DNA, 27 bp, Artificial Sequence
  IGL V-segment Forward Primer
cttgagacagaccgccacactcacctg

SEQ ID NO: 666 - DNA, 37 bp, Artificial Sequence
  IGK V-segment Forward Primer
gtaaataattgcattttttaatgaccgtgggtctgtg

SEQ ID NO: 667 - DNA, 58 bp, Artificial Sequence
  IGK V-segment Forward Primer with Universal Adaptor
gggctggcaagccacgtttggtgtctgcatctgtaggagacagagtcaccatcacttg

SEQ ID NO: 668 - DNA, 58 bp, Artificial Sequence
  IGK V-segment Forward Primer with Universal Adaptor
gggctggcaagccacgtttggtgtctgcatctacaggagacagagtcaccatcacttg

SEQ ID NO: 669 - DNA, 58 bp, Artificial Sequence
  IGK V-segment Forward Primer with Universal Adaptor
gggctggcaagccacgtttggtgctgcatctgtaaggagacagtgtcaccatcacttg

SEQ ID NO: 670 - DNA, 58 bp, Artificial Sequence
  IGK V-segment Forward Primer with Universal Adaptor
gggctggcaagccacgtttggtgtctgcatctacaggagacagagtcaccatcagttg

SEQ ID NO: 671 - DNA, 58 bp, Artificial Sequence
  IGK V-segment Forward Primer with Universal Adaptor
gggctggcaagccacgtttggtgactgcatctgtaggagagagagtcaccatcacttg

SEQ ID NO: 672 - DNA, 56 bp, Artificial Sequence
  IGK V-segment Forward Primer with Universal Adaptor
gggctggcaagccacgtttggtggcatctgtaaggagacagcgtcaccatcacttg

SEQ ID NO: 673 - DNA, 59 bp, Artificial Sequence
  IGK V-segment Forward Primer with Universal Adaptor
gggctggcaagccacgtttggtggtctgcatctgtaggagacagagtcagtatcatttg

SEQ ID NO: 674 - DNA, 46 bp, Artificial Sequence
  IGK V-segment Forward Primer with Universal Adaptor
gggctggcaagccacgtttggtgggagagccggcctccatctcctg

SEQ ID NO: 675 - DNA, 49 bp, Artificial Sequence
  IGK  V-segment Forward Primer with Universal Adaptor
gggctggcaagccacgtttggtgcctggagagccagcctccatctcctg

SEQ ID NO: 676 - DNA, 48 bp, Artificial Sequence
  IGK  V-segment Forward Primer with Universal Adaptor
gggctggcaagccacgtttggtgctggagagccggcctccatctcttg

SEQ ID NO: 677 - DNA, 54 bp, Artificial Sequence
  IGK V-segment Forward Primer with Universal Adaptor
gggctggcaagccacgtttggtgtcttccttggagagccatcctccatttcctg

SEQ ID NO: 678 - DNA, 46 bp, Artificial Sequence
  IGKV-segment Forward Primer with Universal Adaptor
gggctggcaagccacgtttggtgggacagccggcctccatctcctg

SEQ ID NO: 679 - DNA, 47 bp, Artificial Sequence
  IGK  V-segment Forward Primer with Universal Adaptor
gggctggcaagccacgtttggtgtggagagccggcctccatctcctg

SEQ ID NO: 680 - DNA, 59 bp, Artificial Sequence
  IGKV-segment Forward Primer with Universal Adaptor
gggctggcaagccacgtttggtgataatatttgtacataactttgtacttcatctcctg

SEQ ID NO: 681 - DNA, 51 bp, Artificial Sequence
  IGK V-segment Forward Primer with Universal Adaptor
gggctggcaagccacgtttggtgcccctggaaagccagcctctatctcctg

SEQ ID NO: 682 - DNA, 55 bp, Artificial Sequence
  IGK  V-segment Forward Primer with Universal Adaptor
gggctggcaagccacgtttggtgctcttccttggagagccatcctccatttcctg

SEQ ID NO: 683 - DNA, 46 bp, Artificial Sequence
  IGK V-segment Forward Primer with Universal Adaptor
gggctggcaagccacgtttggtgggacagccggcctccatctcctt

SEQ ID NO: 684 - DNA, 49 bp, Artificial Sequence
  IGK  V-segment Forward Primer with Universal Adaptor
gggctggcaagccacgtttggtgcctggagagcaggcctccatgtcctg

SEQ ID NO: 685 - DNA, 49 bp, Artificial Sequence
  IGK V-segment Forward Primer with Universal Adaptor
gggctggcaagccacgtttggtgccaggggaaagagccaccctctcctg

SEQ ID NO: 686 - DNA, 50 bp, Artificial Sequence
  IGK  V-segment Forward Primer with Universal Adaptor
gggctggcaagccacgtttggtgtccaggggaaagagtcaccctctcctg

SEQ ID NO: 687 - DNA, 58 bp, Artificial Sequence
  IGK  V-segment Forward Primer with Universal Adaptor
gggctggcaagccacgtttggtgtctttgtctctggagaaaaaagccaccctgacttg

SEQ ID NO: 688 - DNA, 52 bp, Artificial Sequence
  IGK V-segment Forward Primer with Universal Adaptor
gggctggcaagccacgtttggtgtctctaggggaaaaagccaccctcaccta

SEQ ID NO: 689 - DNA, 46 bp, Artificial Sequence
  IGK V-segment Forward Primer with Universal Adaptor
gggctggcaagccacgtttggtgggggaaggagccaccctcacctg

SEQ ID NO: 690 - DNA, 47 bp, Artificial Sequence
  IGK V-segment Forward Primer with Universal Adaptor
gggctggcaagccacgtttggtggggcgagagggccaccatcaactg

SEQ ID NO: 691 - DNA, 55 bp, Artificial Sequence
  IGK V-segment Forward Primer with Universal Adaptor
gggctggcaagccacgtttggtggcgactccaggagacaaagtcaacatctcctg

SEQ ID NO: 692 - DNA, 57 bp, Artificial Sequence
  IGK V-segment Forward Primer with Universal Adaptor
gggctggcaagccacgtttggtgctgtgactccaaaggagaaagtcaccatcacctg

SEQ ID NO: 693 - DNA, 52 bp, Artificial Sequence
  IGK V-segment Forward Primer with Universal Adaptor
gggctggcaagccacgtttggtgactccaggggagaaagtcaccatcacctg

SEQ ID NO: 694 - DNA, 48 bp, Artificial Sequence
  IGK V-segment Forward Primer with Universal Adaptor
gggctggcaagccacgtttggtgcaggacagagggccaccatcacctg

SEQ ID NO: 695 - DNA, 49 bp, Artificial Sequence
  IGL V-segment Forward Primer with Universal Adaptor
gggctggcaagccacgtttggtgcccaggcagagggtcaccatctcctg

SEQ ID NO: 696 - DNA, 49 bp, Artificial Sequence
  IGL V-segment Forward Primer with Universal Adaptor
gggctggcaagccacgtttggtgccagggcagagggtcaccatctcctg

SEQ ID NO: 697 - DNA, 48 bp, Artificial Sequence
  IGL V-segment Forward Primer with Universal Adaptor
gggctggcaagccacgtttggtgccgggcagagggtcaccatctcttg

SEQ ID NO: 698 - DNA, 51 bp, Artificial Sequence
  IGL V-segment Forward Primer with Universal Adaptor
gggctggcaagccacgtttggtgccccaggacagaaggtcaccatctcctg

SEQ ID NO: 699 - DNA, 51 bp, Artificial Sequence
  IGL V-segment Forward Primer with Universal Adaptor
gggctggcaagccacgtttggtgccacaaggcagaggctcactgtctcctg

SEQ ID NO: 700 - DNA, 53 bp, Artificial Sequence
  IGL V-segment Forward Primer with Universal Adaptor
gggctggcaagccacgtttggtggtctcctggacagtcagtcaccatctcctg

SEQ ID NO: 701 - DNA, 53 bp, Artificial Sequence
  IGL V-segment Forward Primer with Universal Adaptor
gggctggcaagccacgtttggtggtctcctggacagtcgatcaccatctcctg

SEQ ID NO: 702 - DNA, 50 bp, Artificial Sequence
  IGL V-segment Forward Primer with Universal Adaptor
gggctggcaagccacgtttggtgtcctggacagtcggtcaccatctcctg

SEQ ID NO: 703 - DNA, 56 bp, Artificial Sequence
  IGL V-segment Forward Primer with Universal Adaptor
gggctggcaagccacgtttggtgctgggacttggggtaaacagtcaccatcttctg

SEQ ID NO: 704 - DNA, 49 bp, Artificial Sequence
  IGL V-segment Forward Primer with Universal Adaptor
gggctggcaagccacgtttggtgccaggacagacagccagcatcacctg

SEQ ID NO: 705 - DNA, 51 bp, Artificial Sequence
  IGL V-segment Forward Primer with Universal Adaptor
gggctggcaagccacgtttggtgctttgggacgtacggccaggatcatctg

SEQ ID NO: 706 - DNA, 51 bp, Artificial Sequence
  IGL V-segment Forward Primer with Universal Adaptor
gggctggcaagccacgtttggtgctttgggacagatggccaggatcacctg

SEQ ID NO: 707 - DNA, 49 bp, Artificial Sequence
  IGL V-segment Forward Primer with Universal Adaptor
gggctggcaagccacgtttggtgccaggacaggcagccatgatcacctg

SEQ ID NO: 708 - DNA, 48 bp, Artificial Sequence
  IGL V-segment Forward Primer with Universal Adaptor
gggctggcaagccacgtttggtgtgggacagagggccaggatcaccta

SEQ ID NO: 709 - DNA, 47 bp, Artificial Sequence
  IGL V-segment Forward Primer with Universal Adaptor
gggctggcaagccacgtttggtggggacaggcggccaggattacctg

SEQ ID NO: 710 - DNA, 49 bp, Artificial Sequence
  IGL V-segment Forward Primer with Universal Adaptor
gggctggcaagccacgtttggtgccaggacaaacggccaggatcacctg

SEQ ID NO: 711 - DNA, 50 bp, Artificial Sequence
  IGL V-segment Forward Primer with Universal Adaptor
gggctggcaagccacgtttggtgcacagcacagatggccaggatcacctg

SEQ ID NO: 712 - DNA, 49 bp, Artificial Sequence
  IGL V-segment Forward Primer with Universal Adaptor
gggctggcaagccacgtttggtgccaggacagacagccaggatcagctg

SEQ ID NO: 713 - DNA, 51 bp, Artificial Sequence
  IGL V-segment Forward Primer with Universal Adaptor
gggctggcaagccacgtttggtgccccaggacagatgaccaggatcacctg

SEQ ID NO: 714 - DNA, 51 bp, Artificial Sequence
  IGL V-segment Forward Primer with Universal Adaptor
gggctggcaagccacgtttggtgccctaggacagatggccaggatcacctg

SEQ ID NO: 715 - DNA, 54 bp, Artificial Sequence
  IGL V-segment Forward Primer with Universal Adaptor
gggctggcaagccacgtttggtggtgtctgtggacagtcagcaagggtaacctg

SEQ ID NO: 716 - DNA, 53 bp, Artificial Sequence
  IGL V-segment Forward Primer with Universal Adaptor
gggctggcaagccacgtttggtgggccttgggacagacagtcaggatcacatg

SEQ ID NO: 717 - DNA, 51 bp, Artificial Sequence
  IGL V-segment Forward Primer with Universal Adaptor
gggctggcaagccacgtttggtgccccaggaaagacggccaggattacctg

SEQ ID NO: 718 - DNA, 50 bp, Artificial Sequence
  IGL V-segment Forward Primer with Universal Adaptor
gggctggcaagccacgtttggtgcccaggacagaaagccaggatcacctg

SEQ ID NO: 719 - DNA, 57 bp, Artificial Sequence
  IGL V-segment Forward Primer with Universal Adaptor
gggctggcaagccacgtttggtgcagtagctccaggacagatgactaggatcacctg

SEQ ID NO: 720 - DNA, 48 bp, Artificial Sequence
  IGL V-segment Forward Primer with Universal Adaptor
gggctggcaagccacgtttggtgcaggacagacggccaggatcacctg

SEQ ID NO: 721 - DNA, 50 bp, Artificial Sequence
  IGL V-segment Forward Primer with Universal Adaptor
gggctggcaagccacgtttggtgcctgggacagtcagccagggtaacctg

SEQ ID NO: 722 - DNA, 48 bp, Artificial Sequence
  IGL V-segment Forward Primer with Universal Adaptor
gggctggcaagccacgtttggtgcgggacagacagccaggatcacctg

SEQ ID NO: 723 - DNA, 50 bp, Artificial Sequence
  IGL V-segment Forward Primer with Universal Adaptor
gggctggcaagccacgtttggtgcccaggacagacacccaggatcacctg

SEQ ID NO: 724 - DNA, 51 bp, Artificial Sequence
  IGL V-segment Forward Primer with Universal Adaptor
gggctggcaagccacgtttggtgccccattacagatggccaggatcacctg

SEQ ID NO: 725 - DNA, 52 bp, Artificial Sequence
  IGL V-segment Forward Primer with Universal Adaptor
gggctggcaagccacgtttggtggccttgggatagacagccaggatcacctg

SEQ ID NO: 726 - DNA, 51 bp, Artificial Sequence
  IGL V-segment Forward Primer with Universal Adaptor
gggctggcaagccacgtttggtgccttgggacaaatggccaggatcacctg

SEQ ID NO: 727 - DNA, 49 bp, Artificial Sequence
  IGL V-segment Forward Primer with Universal Adaptor
gggctggcaagccacgtttggtgctgggagcctcgatcaagctcacctg

SEQ ID NO: 728 - DNA, 50 bp, Artificial Sequence
  IGL V-segment Forward Primer with Universal Adaptor
gggctggcaagccacgtttggtgcctgggatcctcggtcaagctcacctg

SEQ ID NO: 729 - DNA, 47 bp, Artificial Sequence
  IGL V-segment Forward Primer with Universal Adaptor
gggctggcaagccacgtttggtggggagcctcggtcaagctcacctg

SEQ ID NO: 730 - DNA, 50 bp, Artificial Sequence
  IGL V-segment Forward Primer with Universal Adaptor
gggctggcaagccacgtttggtgtcctggagaatccgccagactcacctg

SEQ ID NO: 731 - DNA, 52 bp, Artificial Sequence
  IGL V-segment Forward Primer with Universal Adaptor
gggctggcaagccacgtttggtgtctcctggagcatcagccagattcacctg

SEQ ID NO: 732 - DNA, 50 bp, Artificial Sequence
  IGL V-segment Forward Primer with Universal Adaptor
gggctggcaagccacgtttggtgtcctggagcatcagccagtctcacctg

SEQ ID NO: 733 - DNA, 50 bp, Artificial Sequence
  IGL V-segment Forward Primer with Universal Adaptor
gggctggcaagccacgtttggtgtcctggagcatcagccagactcacctg

SEQ ID NO: 734 - DNA, 55 bp, Artificial Sequence
  IGL V-segment Forward Primer with Universal Adaptor
gggctggcaagccacgtttggtggcatcttctggagcatcagtcagactcacctg

SEQ ID NO: 735 - DNA, 50 bp, Artificial Sequence
  IGL V-segment Forward Primer with Universal Adaptor
gggctggcaagccacgtttggtgcccaggagggacagtcactctcaccta

SEQ ID NO: 736 - DNA, 50 bp, Artificial Sequence
  IGL V-segment Forward Primer with Universal Adaptor
gggctggcaagccacgtttggtgcccaggagggacagtcactctcacctg

SEQ ID NO: 737 - DNA, 51 bp, Artificial Sequence
  IGL V-segment Forward Primer with Universal Adaptor
gggctggcaagccacgtttggtgcccctggagggacagtcacactcacttg

SEQ ID NO: 738 - DNA, 48 bp, Artificial Sequence
  IGL V-segment Forward Primer with Universal Adaptor
gggctggcaagccacgtttggtgtgggagcctcggtcacactcacctg

SEQ ID NO: 739 - DNA, 50 bp, Artificial Sequence
  IGL V-segment Forward Primer with Universal Adaptor
gggctggcaagccacgtttggtgcttgagacagaccgccacactcacctg

SEQ ID NO: 740 - DNA, 60 bp, Artificial Sequence
  IGK  V-segment Forward Primer with Universal Adaptor
gggctggcaagccacgtttggtggtaaataattgcattttttaatgaccgtgggtctgtg

SEQ ID NO: 741 - DNA, 32 bp, Artificial Sequence
  IGK J-Segment Reverse Primers
ttctactcacgtttgatttccaccttggtccc

SEQ ID NO: 742 - DNA, 32 bp, Artificial Sequence
  IGK J-Segment Reverse Primers
aagtacttacgtttgatctccagcttggtccc

SEQ ID NO: 743 - DNA, 36 bp, Artificial Sequence
  IGK J-Segment Reverse Primers
acagatgtacttacgtttgatatccactttggtccc

SEQ ID NO: 744 - DNA, 29 bp, Artificial Sequence
  IGK J-Segment Reverse Primers
cacttacgtttgatctccaccttggtccc

SEQ ID NO: 745 - DNA, 36 bp, Artificial Sequence
  IGK J-Segment Reverse Primers
gaaaaattacttacgtttaatctccagtcgtgtccc

SEQ ID NO: 746 - DNA, 27 bp, Artificial Sequence
  IGL J-Segment Reverse Primers
cttacctaggacggtgaccttggtccc

SEQ ID NO: 747 - DNA, 24 bp, Artificial Sequence
  IGL J-Segment Reverse Primers
acctaggacggtcagcttggtccc

SEQ ID NO: 748 - DNA, 36 bp, Artificial Sequence
  IGL J-Segment Reverse Primers
aagaagagactcatctaaaatgatcagctgggttcc

SEQ ID NO: 749 - DNA, 24 bp, Artificial Sequence
  IGL J-Segment Reverse Primers
atctaggacggtcagctccgtccc

SEQ ID NO: 750 - DNA, 21 bp, Artificial Sequence
  IGL J-Segment Reverse Primers
gaggacggtcaccttggtgcc

SEQ ID NO: 751 - DNA, 20 bp, Artificial Sequence
  IGL J-Segment Reverse Primers
aggacggtcagctgggtgcc

SEQ ID NO: 752 - DNA, 24 bp, Artificial Sequence
  IGL J-Segment Reverse Primers
ctgcagactcatgaggagtcgccc

SEQ ID NO: 753 - DNA, 55 bp, Artificial Sequence
  IGK J-Segment Reverse Primer
ccgggagctgcatgtgtcagaggttctactcacgtttgatttccaccttggtccc

SEQ ID NO: 754 - DNA, 55 bp, Artificial Sequence
  IGK J-Segment Reverse Primer
ccgggagctgcatgtgtcagaggaagtacttacgtttgatctccagcttggtccc

SEQ ID NO: 755 - DNA, 59 bp, Artificial Sequence
  IGK J-Segment Reverse Primer
ccgggagctgcatgtgtcagaggacagatgtacttacgtttgatatccactttggtccc

SEQ ID NO: 756 - DNA, 52 bp, Artificial Sequence
  IGK J-Segment Reverse Primer
ccgggagctgcatgtgtcagaggcacttacgtttgatctccaccttggtccc

SEQ ID NO: 757 - DNA, 59 bp, Artificial Sequence
  IGK J-Segment Reverse Primer
ccgggagctgcatgtgtcagagggaaaaattacttacgtttaatctccagtcgtgtccc

SEQ ID NO: 758 - DNA, 50 bp, Artificial Sequence
  IGL J-Segment Reverse Primer
ccgggagctgcatgtgtcagaggcttacctaggacggtgaccttggtccc

SEQ ID NO: 759 - DNA, 47 bp, Artificial Sequence
  IGL J-Segment Reverse Primer
ccgggagctgcatgtgtcagaggacctaggacggtcagcttggtccc

SEQ ID NO: 760 - DNA, 59 bp, Artificial Sequence
  IGL J-Segment Reverse Primer
ccgggagctgcatgtgtcagaggaagaagagactcatctaaaatgatcagctgggttcc

SEQ ID NO: 761 - DNA, 47 bp, Artificial Sequence
  IGL J-Segment Reverse Primer
ccgggagctgcatgtgtcagaggatctaggacggtcagctccgtccc

SEQ ID NO: 762 - DNA, 44 bp, Artificial Sequence
  IGL J-Segment Reverse Primer
ccgggagctgcatgtgtcagagggaggacggtcaccttggtgcc

SEQ ID NO: 763 - DNA, 43 bp, Artificial Sequence
  IGL J-Segment Reverse Primer
ccgggagctgcatgtgtcagaggaggacggtcagctgggtgcc

SEQ ID NO: 764 - DNA, 47 bp, Artificial Sequence
  IGL J-Segment Reverse Primer
ccgggagctgcatgtgtcagaggctgcagactcatgaggagtcgccc

SEQ ID NO: 765 - DNA, 18 bp, Artificial Sequence
  Exemplary Adaptor Sequence
aatacgactcactatagg

SEQ ID NO: 766 - DNA, 19 bp, Artificial Sequence
  Exemplary Adaptor Sequence
gctagttattgctcagcgg

SEQ ID NO: 767 - DNA, 18 bp, Artificial Sequence
  Exemplary Adaptor Sequence
attaaccctcactaaagg

SEQ ID NO: 768 - DNA, 19 bp, Artificial Sequence
  Exemplary Adaptor Sequence
gatttaggtgacactatag

SEQ ID NO: 769 - DNA, 18 bp, Artificial Sequence
  Exemplary Adaptor Sequence
tgtaaaacgacggccagt

SEQ ID NO: 770 - DNA, 17 bp, Artificial Sequence
  Exemplary Adaptor Sequence
gttttcccagtcacgac

SEQ ID NO: 771 - DNA, 18 bp, Artificial Sequence
  Exemplary Adaptor Sequence
caggaaacagctatgacc

SEQ ID NO: 772 - DNA, 21 bp, Artificial Sequence
  Exemplary Adaptor Sequence
gactggttccaattgacaagc

SEQ ID NO: 773 - DNA, 21 bp, Artificial Sequence
  Exemplary Adaptor Sequence
gcaaatggcattctgacatcc

SEQ ID NO: 774 - DNA, 23 bp, Artificial Sequence
  Exemplary Adaptor Sequence
gggctggcaagccacgtttggtg

SEQ ID NO: 775 - DNA, 23 bp, Artificial Sequence
  Exemplary Adaptor Sequence
ccgggagctgcatgtgtcagagg

SEQ ID NO: 776 - DNA, 22 bp, Artificial Sequence
  Exemplary Adaptor Sequence
aactagaaggcacagtcgaggc

SEQ ID NO: 777 - DNA, 20 bp, Artificial Sequence
  Exemplary Adaptor Sequence
cactctcggcatggacgagc

SEQ ID NO: 778 - DNA, 20 bp, Artificial Sequence
  Exemplary Adaptor Sequence
tggtgcagatgaacttcagg

SEQ ID NO: 779 - DNA, 20 bp, Artificial Sequence
  Exemplary Adaptor Sequence
gttcgaccccgcctcgatcc

SEQ ID NO: 780 - DNA, 21 bp, Artificial Sequence
  Exemplary Adaptor Sequence
tgacacacattccacagggtc

SEQ ID NO: 781 - DNA, 19 bp, Artificial Sequence
  Exemplary Adaptor Sequence
gcgtgaatgtaagcgtgac

SEQ ID NO: 782 - DNA, 20 bp, Artificial Sequence
  Exemplary Adaptor Sequence
ggattattcataccgtccca

SEQ ID NO: 783 - DNA, 20 bp, Artificial Sequence
  Exemplary Adaptor Sequence
caaatgtggtatggctgatt

SEQ ID NO: 784 - DNA, 20 bp, Artificial Sequence
  Exemplary Adaptor Sequence
atgccatagcatttttatcc

SEQ ID NO: 785 - DNA, 18 bp, Artificial Sequence
  Exemplary Adaptor Sequence
gatttaatctgtatcagg

SEQ ID NO: 786 - DNA, 21 bp, Artificial Sequence
  Exemplary Adaptor Sequence
cgcaaatgggcggtaggcgtg

SEQ ID NO: 787 - DNA, 495 bp, Artificial Sequence
  Synthetic Template Oligonucleotide for TCRB Locus
gccttgccagcccgctcagacacacgtgacactcttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgacactctgtcgacactgaagctttctttggacaaggcaccagactcacagttgtaggtaagacatttttcaggttcttttgcagatccgtcacagggaaaagtgggtccacagacacacgtgacactctctgatggcgcgagggaggc

SEQ ID NO: 788 - DNA, 495 bp, Artificial Sequence
  Synthetic Template Oligonucleotide for TCRB Locus
gccttgccagcccgctcagacacacgtttcggaactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtttcggaacgtcgactatggctacaccttcggttcggggaccaggttaaccgttgtaggtaaggctgggggtctctaggaggggtgcgatgagggaggactctgtcctgggaaatacacacgtttcggaacctgatggcgcgagggaggc

SEQ ID NO: 789 - DNA, 495 bp, Artificial Sequence
  Synthetic Template Oligonucleotide for TCRB Locus
gccttgccagcccgctcagacacacgtaagtaacgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtaagtaacggtcgacgaaacaccatatattttggagagggaagttggctcactgttgtaggtgagtaagtcaaggctggacagctgggaacttgcaaaaaggggctggaatccagacacacgtaagtaacgctgatggcgcgagggaggc

SEQ ID NO: 790 - DNA, 495 bp, Artificial Sequence
  Synthetic Template Oligonucleotide for TCRB Locus
gccttgccagcccgctcagacacacgtgtctcctatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtctcctagtcgacaatgaaaaactgttttttggcagtggaacccagctctctgtcttgggtatgtaaaagacttctttcgggatagtgtatcataaggtcggagttccaggagacacacgtgtctcctactgatggcgcgagggaggc

SEQ ID NO: 791 - DNA, 495 bp, Artificial Sequence
  Synthetic Template Oligonucleotide for TCRB Locus
gccttgccagcccgctcagacacacgtagagtgtctcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtagagtgtcgtcgacatcagccccagcattttggtgatgggactcgactctccatcctaggtaagttgcagaatcagggtggtatggccattgtcccttgaaggcagagttctctacacacgtagagtgtcctgatggcgcgagggaggc

SEQ ID NO: 792 - DNA, 495 bp, Artificial Sequence
  Synthetic Template Oligonucleotide for TCRB Locus
gccttgccagcccgctcagacacacgtgttccgaatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgttccgaagtcgacataattcacccctccactttgggaacgggaccaggctcactgtgacaggtatgggggctccactcttgactcgggggtgcctgggtttgactgcaatgatacacacgtgttccgaactgatggcgcgagggaggc

SEQ ID NO: 793 - DNA, 495 bp, Artificial Sequence
  Synthetic Template Oligonucleotide for TCRB Locus
gccttgccagcccgctcagacacacgtcgttactttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtcgttacttgtcgacacaatgagcagttcttcgggccagggacacggctcaccgtgctaggtaagaagggggctccaggtgggagagagggtgagcagcccagcctgcacgacccacacacgtcgttacttctgatggcgcgagggaggc

SEQ ID NO: 794 - DNA, 495 bp, Artificial Sequence
  Synthetic Template Oligonucleotide for TCRB Locus
gccttgccagcccgctcagacacacgttaggagactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgttaggagacgtcgacaccggggagctgttttttggagaaggctctaggctgaccgtactgggtaaggaggcggttggggctccggagagctccgagagggcgggatgggcagaggacacacgttaggagacctgatggcgcgagggaggc

SEQ ID NO: 795 - DNA, 495 bp, Artificial Sequence
  Synthetic Template Oligonucleotide for TCRB Locus
gccttgccagcccgctcagacacacgtgtgtctactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtgtctacgtcgacagatacgcagtattttggcccaggcacccggctgacagtgctcggtaagcgggggctcccgctgaagccccggaactggggagggggcgccccgggacgcacacacgtgtgtctacctgatggcgcgagggaggc

SEQ ID NO: 796 - DNA, 495 bp, Artificial Sequence
  Synthetic Template Oligonucleotide for TCRB Locus
gccttgccagcccgctcagacacacgtgtacagtgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtacagtggtcgacaaaacattcagtacttcggcgccgggacccggctctcagtgctgggtaagctggggccgccgggggaccggggacgagactgcgctcgggtttttgtgcgacacacgtgtacagtgctgatggcgcgagggaggc

SEQ ID NO: 797 - DNA, 495 bp, Artificial Sequence
  Synthetic Template Oligonucleotide for TCRB Locus
gccttgccagcccgctcagacacacgtggatcatctcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtggatcatcgtcgacgagacccagtacttcgggccaggcacgcggctcctggtgctcggtgagcgcgggctgctggggcgcgggcgcgggcggcttgggtctggtttttgcggggacacacgtggatcatcctgatggcgcgagggaggc

SEQ ID NO: 798 - DNA, 495 bp, Artificial Sequence
  Synthetic Template Oligonucleotide for TCRB Locus
gccttgccagcccgctcagacacacgttattggcgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgttattggcggtcgacgggccaacgtcctgactttcggggccggcagcaggctgaccgtgctgggtgagttttcgcgggaccacccgggcggcgggattcaggtggaaggcggcggacacacgttattggcgctgatggcgcgagggaggc

SEQ ID NO: 799 - DNA, 495 bp, Artificial Sequence
  Synthetic Template Oligonucleotide for TCRB Locus
gccttgccagcccgctcagacacacgtaggcttgatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtaggcttgagtcgacacgagcagtacttcgggccgggcaccaggctcacggtcacaggtgagattcgggcgtctccccaccttccagcccctcggtccccggagtcggagggtggacacacgtaggcttgactgatggcgcgagggaggc

SEQ ID NO: 800 - DNA, 495 bp, Artificial Sequence
  Synthetic Template Oligonucleotide for TCRB Locus
gccttgccagcccgctcagtagacggagacactcttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagacactctgtcgacactgaagctttctttggacaaggcaccagactcacagttgtaggtaagacatttttcaggttcttttgcagatccgtcacagggaaaagtgggtccacagtagacggagacactctctgatggcgcgagggaggc

SEQ ID NO: 801 - DNA, 495 bp, Artificial Sequence
  Synthetic Template Oligonucleotide for TCRB Locus
gccttgccagcccgctcagtagacggattcggaactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggattcggaacgtcgactatggctacaccttcggttcggggaccaggttaaccgttgtaggtaaggctgggggtctctaggaggggtgcgatgagggaggactctgtcctgggaaattagacggattcggaacctgatggcgcgagggaggc

SEQ ID NO: 802 - DNA, 495 bp, Artificial Sequence
  Synthetic Template Oligonucleotide for TCRB Locus
gccttgccagcccgctcagtagacggaaagtaacgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaaagtaacggtcgacgaaacaccatatattttggagagggaagttggctcactgttgtaggtgagtaagtcaaggctggacagctgggaacttgcaaaaaggggctggaatccagtagacggaaagtaacgctgatggcgcgagggaggc

SEQ ID NO: 803 - DNA, 495 bp, Artificial Sequence
  Synthetic Template Oligonucleotide for TCRB Locus
gccttgccagcccgctcagtagacggagtctcctatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtctcctagtcgacaatgaaaaactgttttttggcagtggaacccagctctctgtcttgggtatgtaaaagacttctttcgggatagtgtatcataaggtcggagttccaggagtagacggagtctcctactgatggcgcgagggaggc

SEQ ID NO: 804 - DNA, 495 bp, Artificial Sequence
  Synthetic Template Oligonucleotide for TCRB Locus
gccttgccagcccgctcagtagacggaagagtgtctctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaagagtgtcgtcgacatcagccccagcattttggtgatgggactcgactctccatcctaggtaagttgcagaatcagggtggtatggccattgtcccttgaaggcagagttctcttagacggaagagtgtcctgatggcgcgagggaggc

SEQ ID NO: 805 - DNA, 495 bp, Artificial Sequence
  Synthetic Template Oligonucleotide for TCRB Locus
gccttgccagcccgctcagtagacggagttccgaatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagttccgaagtcgacataattcacccctccactttgggaacgggaccaggctcactgtgacaggtatgggggctccactcttgactcgggggtgcctgggtttgactgcaatgattagacggagttccgaactgatggcgcgagggaggc

SEQ ID NO: 806 - DNA, 495 bp, Artificial Sequence
  Synthetic Template Oligonucleotide for TCRB Locus
gccttgccagcccgctcagtagacggacgttactttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggacgttacttgtcgacacaatgagcagttcttcgggccagggacacggctcaccgtgctaggtaagaagggggctccaggtgggagagagggtgagcagcccagcctgcacgaccctagacggacgttacttctgatggcgcgagggaggc

SEQ ID NO: 807 - DNA, 495 bp, Artificial Sequence
  Synthetic Template Oligonucleotide for TCRB Locus
gccttgccagcccgctcagtagacggataggagactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggataggagacgtcgacaccggggagctgttttttggagaaggctctaggctgaccgtactgggtaaggaggcggttggggctccggagagctccgagagggcgggatgggcagaggtagacggataggagacctgatggcgcgagggaggc

SEQ ID NO: 808 - DNA, 495 bp, Artificial Sequence
  Synthetic Template Oligonucleotide for TCRB Locus
gccttgccagcccgctcagtagacggagtgtctactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtgtctacgtcgacagatacgcagtattttggcccaggcacccggctgacagtgctcggtaagcgggggctcccgctgaagccccggaactggggagggggcgccccgggacgctagacggagtgtctacctgatggcgcgagggaggc

SEQ ID NO: 809 - DNA, 495 bp, Artificial Sequence
  Synthetic Template Oligonucleotide for TCRB Locus
gccttgccagcccgctcagtagacggagtacagtgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtacagtggtcgacaaaacattcagtacttcggcgccgggacccggctctcagtgctgggtaagctggggccgccgggggaccggggacgagactgcgctcgggtttttgtgcgtagacggagtacagtgctgatggcgcgagggaggc

SEQ ID NO: 810 - DNA, 495 bp, Artificial Sequence
  Synthetic Template Oligonucleotide for TCRB Locus
gccttgccagcccgctcagtagacggaggatcatctctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaggatcatcgtcgacgagacccagtacttcgggccaggcacgcggctcctggtgctcggtgagcgcgggctgctggggcgcgggcgcgggcggcttgggtctggtttttgcggggtagacggaggatcatcctgatggcgcgagggaggc

SEQ ID NO: 811 - DNA, 495 bp, Artificial Sequence
  Synthetic Template Oligonucleotide for TCRB Locus
gccttgccagcccgctcagtagacggatattggcgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggatattggcggtcgacgggccaacgtcctgactttcggggccggcagcaggctgaccgtgctgggtgagttttcgcgggaccacccgggcggcgggattcaggtggaaggcggcggtagacggatattggcgctgatggcgcgagggaggc

SEQ ID NO: 812 - DNA, 495 bp, Artificial Sequence
  Synthetic Template Oligonucleotide for TCRB Locus
gccttgccagcccgctcagtagacggaaggcttgatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaaggcttgagtcgacacgagcagtacttcgggccgggcaccaggctcacggtcacaggtgagattcgggcgtctccccaccttccagcccctcggtccccggagtcggagggtggtagacggaaggcttgactgatggcgcgagggaggc

SEQ ID NO: 813 - DNA, 495 bp, Artificial Sequence
  Synthetic Template Oligonucleotide for TCRB Locus
gccttgccagcccgctcagcagctcttgacactctttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgacactctgtcgacactgaagctttctttggacaaggcaccagactcacagttgtaggtaagacatttttcaggttcttttgcagatccgtcacagggaaaagtgggtccacagcagctcttgacactctctgatggcgcgagggaggc

SEQ ID NO: 814 - DNA, 495 bp, Artificial Sequence
  Synthetic Template Oligonucleotide for TCRB Locus
gccttgccagcccgctcagcagctcttttcggaacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttttcggaacgtcgactatggctacaccttcggttcggggaccaggttaaccgttgtaggtaaggctgggggtctctaggaggggtgcgatgagggaggactctgtcctgggaaatcagctcttttcggaacctgatggcgcgagggaggc

SEQ ID NO: 815 - DNA, 495 bp, Artificial Sequence
  Synthetic Template Oligonucleotide for TCRB Locus
gccttgccagcccgctcagcagctcttaagtaacgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttaagtaacggtcgacgaaacaccatatattttggagagggaagttggctcactgttgtaggtgagtaagtcaaggctggacagctgggaacttgcaaaaaggggctggaatccagcagctcttaagtaacgctgatggcgcgagggaggc

SEQ ID NO: 816 - DNA, 495 bp, Artificial Sequence
  Synthetic Template Oligonucleotide for TCRB Locus
gccttgccagcccgctcagcagctcttgtctcctattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtctcctagtcgacaatgaaaaactgttttttggcagtggaacccagctctctgtcttgggtatgtaaaagacttctttcgggatagtgtatcataaggtcggagttccaggagcagctcttgtctcctactgatggcgcgagggaggc

SEQ ID NO: 817 - DNA, 495 bp, Artificial Sequence
  Synthetic Template Oligonucleotide for TCRB Locus
gccttgccagcccgctcagcagctcttagagtgtcttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttagagtgtcgtcgacatcagccccagcattttggtgatgggactcgactctccatcctaggtaagttgcagaatcagggtggtatggccattgtcccttgaaggcagagttctctcagctcttagagtgtcctgatggcgcgagggaggc

SEQ ID NO: 818 - DNA, 495 bp, Artificial Sequence
  Synthetic Template Oligonucleotide for TCRB Locus
gccttgccagcccgctcagcagctcttgttccgaattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgttccgaagtcgacataattcacccctccactttgggaacgggaccaggctcactgtgacaggtatgggggctccactcttgactcgggggtgcctgggtttgactgcaatgatcagctcttgttccgaactgatggcgcgagggaggc

SEQ ID NO: 819 - DNA, 495 bp, Artificial Sequence
  Synthetic Template Oligonucleotide for TCRB Locus
gccttgccagcccgctcagcagctcttcgttacttttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttcgttacttgtcgacacaatgagcagttcttcgggccagggacacggctcaccgtgctaggtaagaagggggctccaggtgggagagagggtgagcagcccagcctgcacgaccccagctcttcgttacttctgatggcgcgagggaggc

SEQ ID NO: 820 - DNA, 495 bp, Artificial Sequence
  Synthetic Template Oligonucleotide for TCRB Locus
gccttgccagcccgctcagcagctctttaggagacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctctttaggagacgtcgacaccggggagctgttttttggagaaggctctaggctgaccgtactgggtaaggaggcggttggggctccggagagctccgagagggcgggatgggcagaggcagctctttaggagacctgatggcgcgagggaggc

SEQ ID NO: 821 - DNA, 495 bp, Artificial Sequence
  Synthetic Template Oligonucleotide for TCRB Locus
gccttgccagcccgctcagcagctcttgtgtctacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtgtctacgtcgacagatacgcagtattttggcccaggcacccggctgacagtgctcggtaagcgggggctcccgctgaagccccggaactggggagggggcgccccgggacgccagctcttgtgtctacctgatggcgcgagggaggc

SEQ ID NO: 822 - DNA, 495 bp, Artificial Sequence
  Synthetic Template Oligonucleotide for TCRB Locus
gccttgccagcccgctcagcagctcttgtacagtgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtacagtggtcgacaaaacattcagtacttcggcgccgggacccggctctcagtgctgggtaagctggggccgccgggggaccggggacgagactgcgctcgggtttttgtgcgcagctcttgtacagtgctgatggcgcgagggaggc

SEQ ID NO: 823 - DNA, 495 bp, Artificial Sequence
  Synthetic Template Oligonucleotide for TCRB Locus
gccttgccagcccgctcagcagctcttggatcatcttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttggatcatcgtcgacgagacccagtacttcgggccaggcacgcggctcctggtgctcggtgagcgcgggctgctggggcgcgggcgcgggcggcttgggtctggtttttgcggggcagctcttggatcatcctgatggcgcgagggaggc

SEQ ID NO: 824 - DNA, 495 bp, Artificial Sequence
  Synthetic Template Oligonucleotide for TCRB Locus
gccttgccagcccgctcagcagctctttattggcgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctctttattggcggtcgacgggccaacgtcctgactttcggggccggcagcaggctgaccgtgctgggtgagttttcgcgggaccacccgggcggcgggattcaggtggaaggcggcggcagctctttattggcgctgatggcgcgagggaggc

SEQ ID NO: 825 - DNA, 495 bp, Artificial Sequence
  Synthetic Template Oligonucleotide for TCRB Locus
gccttgccagcccgctcagcagctcttaggcttgattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttaggcttgagtcgacacgagcagtacttcgggccgggcaccaggctcacggtcacaggtgagattcgggcgtctccccaccttccagcccctcggtccccggagtcggagggtggcagctcttaggcttgactgatggcgcgagggaggc

SEQ ID NO: 826 - DNA, 495 bp, Artificial Sequence
  Synthetic Template Oligonucleotide for TCRB Locus
gccttgccagcccgctcaggagcgatagacactctttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagacactctgtcgacactgaagctttctttggacaaggcaccagactcacagttgtaggtaagacatttttcaggttcttttgcagatccgtcacagggaaaagtgggtccacaggagcgatagacactctctgatggcgcgagggaggc

SEQ ID NO: 827 - DNA, 495 bp, Artificial Sequence
  Synthetic Template Oligonucleotide for TCRB Locus
gccttgccagcccgctcaggagcgatattcggaacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatattcggaacgtcgactatggctacaccttcggttcggggaccaggttaaccgttgtaggtaaggctgggggtctctaggaggggtgcgatgagggaggactctgtcctgggaaatgagcgatattcggaacctgatggcgcgagggaggc

SEQ ID NO: 828 - DNA, 495 bp, Artificial Sequence
  Synthetic Template Oligonucleotide for TCRB Locus
gccttgccagcccgctcaggagcgataaagtaacgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataaagtaacggtcgacgaaacaccatatattttggagagggaagttggctcactgttgtaggtgagtaagtcaaggctggacagctgggaacttgcaaaaaggggctggaatccaggagcgataaagtaacgctgatggcgcgagggaggc

SEQ ID NO: 829 - DNA, 495 bp, Artificial Sequence
  Synthetic Template Oligonucleotide for TCRB Locus
gccttgccagcccgctcaggagcgatagtctcctattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtctcctagtcgacaatgaaaaactgttttttggcagtggaacccagctctctgtcttgggtatgtaaaagacttctttcgggatagtgtatcataaggtcggagttccaggaggagcgatagtctcctactgatggcgcgagggaggc

SEQ ID NO: 830 - DNA, 495 bp, Artificial Sequence
  Synthetic Template Oligonucleotide for TCRB Locus
gccttgccagcccgctcaggagcgataagagtgtcttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataagagtgtcgtcgacatcagccccagcattttggtgatgggactcgactctccatcctaggtaagttgcagaatcagggtggtatggccattgtcccttgaaggcagagttctctgagcgataagagtgtcctgatggcgcgagggaggc

SEQ ID NO: 831 - DNA, 495 bp, Artificial Sequence
  Synthetic Template Oligonucleotide for TCRB Locus
gccttgccagcccgctcaggagcgatagttccgaattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagttccgaagtcgacataattcacccctccactttgggaacgggaccaggctcactgtgacaggtatgggggctccactcttgactcgggggtgcctgggtttgactgcaatgatgagcgatagttccgaactgatggcgcgagggaggc

SEQ ID NO: 832 - DNA, 495 bp, Artificial Sequence
  Synthetic Template Oligonucleotide for TCRB Locus
gccttgccagcccgctcaggagcgatacgttacttttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatacgttacttgtcgacacaatgagcagttcttcgggccagggacacggctcaccgtgctaggtaagaagggggctccaggtgggagagagggtgagcagcccagcctgcacgacccgagcgatacgttacttctgatggcgcgagggaggc

SEQ ID NO: 833 - DNA, 495 bp, Artificial Sequence
  Synthetic Template Oligonucleotide for TCRB Locus
gccttgccagcccgctcaggagcgatataggagacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatataggagacgtcgacaccggggagctgttttttggagaaggctctaggctgaccgtactgggtaaggaggcggttggggctccggagagctccgagagggcgggatgggcagagggagcgatataggagacctgatggcgcgagggaggc

SEQ ID NO: 834 - DNA, 495 bp, Artificial Sequence
  Synthetic Template Oligonucleotide for TCRB Locus
gccttgccagcccgctcaggagcgatagtgtctacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtgtctacgtcgacagatacgcagtattttggcccaggcacccggctgacagtgctcggtaagcgggggctcccgctgaagccccggaactggggagggggcgccccgggacgcgagcgatagtgtctacctgatggcgcgagggaggc

SEQ ID NO: 835 - DNA, 495 bp, Artificial Sequence
  Synthetic Template Oligonucleotide for TCRB Locus
gccttgccagcccgctcaggagcgatagtacagtgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtacagtggtcgacaaaacattcagtacttcggcgccgggacccggctctcagtgctgggtaagctggggccgccgggggaccggggacgagactgcgctcgggtttttgtgcggagcgatagtacagtgctgatggcgcgagggaggc

SEQ ID NO: 836 - DNA, 495 bp, Artificial Sequence
  Synthetic Template Oligonucleotide for TCRB Locus
gccttgccagcccgctcaggagcgataggatcatcttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataggatcatcgtcgacgagacccagtacttcgggccaggcacgcggctcctggtgctcggtgagcgcgggctgctggggcgcgggcgcgggcggcttgggtctggtttttgcgggggagcgataggatcatcctgatggcgcgagggaggc

SEQ ID NO: 837 - DNA, 495 bp, Artificial Sequence
  Synthetic Template Oligonucleotide for TCRB Locus
gccttgccagcccgctcaggagcgatatattggcgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatatattggcggtcgacgggccaacgtcctgactttcggggccggcagcaggctgaccgtgctgggtgagttttcgcgggaccacccgggcggcgggattcaggtggaaggcggcgggagcgatatattggcgctgatggcgcgagggaggc

SEQ ID NO: 838 - DNA, 495 bp, Artificial Sequence
  Synthetic Template Oligonucleotide for TCRB Locus
gccttgccagcccgctcaggagcgataaggcttgattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataaggcttgagtcgacacgagcagtacttcgggccgggcaccaggctcacggtcacaggtgagattcgggcgtctccccaccttccagcccctcggtccccggagtcggagggtgggagcgataaggcttgactgatggcgcgagggaggc

SEQ ID NO: 839 - DNA, 495 bp, Artificial Sequence
  Synthetic Template Oligonucleotide for TCRB Locus
gccttgccagcccgctcaggcatctgagacactcttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagacactctgtcgacactgaagctttctttggacaaggcaccagactcacagttgtaggtaagacatttttcaggttcttttgcagatccgtcacagggaaaagtgggtccacaggcatctgagacactctctgatggcgcgagggaggc

SEQ ID NO: 840 - DNA, 495 bp, Artificial Sequence
  Synthetic Template Oligonucleotide for TCRB Locus
gccttgccagcccgctcaggcatctgattcggaactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgattcggaacgtcgactatggctacaccttcggttcggggaccaggttaaccgttgtaggtaaggctgggggtctctaggaggggtgcgatgagggaggactctgtcctgggaaatgcatctgattcggaacctgatggcgcgagggaggc

SEQ ID NO: 841 - DNA, 495 bp, Artificial Sequence
  Synthetic Template Oligonucleotide for TCRB Locus
gccttgccagcccgctcaggcatctgaaagtaacgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaaagtaacggtcgacgaaacaccatatattttggagagggaagttggctcactgttgtaggtgagtaagtcaaggctggacagctgggaacttgcaaaaaggggctggaatccaggcatctgaaagtaacgctgatggcgcgagggaggc

SEQ ID NO: 842 - DNA, 495 bp, Artificial Sequence
  Synthetic Template Oligonucleotide for TCRB Locus
gccttgccagcccgctcaggcatctgagtctcctatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtctcctagtcgacaatgaaaaactgttttttggcagtggaacccagctctctgtcttgggtatgtaaaagacttctttcgggatagtgtatcataaggtcggagttccaggaggcatctgagtctcctactgatggcgcgagggaggc

SEQ ID NO: 843 - DNA, 495 bp, Artificial Sequence
  Synthetic Template Oligonucleotide for TCRB Locus
gccttgccagcccgctcaggcatctgaagagtgtctcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaagagtgtcgtcgacatcagccccagcattttggtgatgggactcgactctccatcctaggtaagttgcagaatcagggtggtatggccattgtcccttgaaggcagagttctctgcatctgaagagtgtcctgatggcgcgagggaggc

SEQ ID NO: 844 - DNA, 495 bp, Artificial Sequence
  Synthetic Template Oligonucleotide for TCRB Locus
gccttgccagcccgctcaggcatctgagttccgaatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagttccgaagtcgacataattcacccctccactttgggaacgggaccaggctcactgtgacaggtatgggggctccactcttgactcgggggtgcctgggtttgactgcaatgatgcatctgagttccgaactgatggcgcgagggaggc

SEQ ID NO: 845 - DNA, 495 bp, Artificial Sequence
  Synthetic Template Oligonucleotide for TCRB Locus
gccttgccagcccgctcaggcatctgacgttactttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgacgttacttgtcgacacaatgagcagttcttcgggccagggacacggctcaccgtgctaggtaagaagggggctccaggtgggagagagggtgagcagcccagcctgcacgacccgcatctgacgttacttctgatggcgcgagggaggc

SEQ ID NO: 846 - DNA, 495 bp, Artificial Sequence
  Synthetic Template Oligonucleotide for TCRB Locus
gccttgccagcccgctcaggcatctgataggagactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgataggagacgtcgacaccggggagctgttttttggagaaggctctaggctgaccgtactgggtaaggaggcggttggggctccggagagctccgagagggcgggatgggcagagggcatctgataggagacctgatggcgcgagggaggc

SEQ ID NO: 847 - DNA, 495 bp, Artificial Sequence
  Synthetic Template Oligonucleotide for TCRB Locus
gccttgccagcccgctcaggcatctgagtgtctactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtgtctacgtcgacagatacgcagtattttggcccaggcacccggctgacagtgctcggtaagcgggggctcccgctgaagccccggaactggggagggggcgccccgggacgcgcatctgagtgtctacctgatggcgcgagggaggc

SEQ ID NO: 848 - DNA, 495 bp, Artificial Sequence
  Synthetic Template Oligonucleotide for TCRB Locus
gccttgccagcccgctcaggcatctgagtacagtgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtacagtggtcgacaaaacattcagtacttcggcgccgggacccggctctcagtgctgggtaagctggggccgccgggggaccggggacgagactgcgctcgggtttttgtgcggcatctgagtacagtgctgatggcgcgagggaggc

SEQ ID NO: 849 - DNA, 495 bp, Artificial Sequence
  Synthetic Template Oligonucleotide for TCRB Locus
gccttgccagcccgctcaggcatctgaggatcatctcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaggatcatcgtcgacgagacccagtacttcgggccaggcacgcggctcctggtgctcggtgagcgcgggctgctggggcgcgggcgcgggcggcttgggtctggtttttgcgggggcatctgaggatcatcctgatggcgcgagggaggc

SEQ ID NO: 850 - DNA, 495 bp, Artificial Sequence
  Synthetic Template Oligonucleotide for TCRB Locus
gccttgccagcccgctcaggcatctgatattggcgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgatattggcggtcgacgggccaacgtcctgactttcggggccggcagcaggctgaccgtgctgggtgagttttcgcgggaccacccgggcggcgggattcaggtggaaggcggcgggcatctgatattggcgctgatggcgcgagggaggc

SEQ ID NO: 851 - DNA, 495 bp, Artificial Sequence
  Synthetic Template Oligonucleotide for TCRB Locus
gccttgccagcccgctcaggcatctgaaggcttgatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaaggcttgagtcgacacgagcagtacttcgggccgggcaccaggctcacggtcacaggtgagattcgggcgtctccccaccttccagcccctcggtccccggagtcggagggtgggcatctgaaggcttgactgatggcgcgagggaggc

SEQ ID NO: 852 - DNA, 495 bp, Artificial Sequence
  Synthetic Template Oligonucleotide for TCRB Locus
gccttgccagcccgctcagtgctacacgacactcttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgacactctgtcgacactgaagctttctttggacaaggcaccagactcacagttgtaggtaagacatttttcaggttcttttgcagatccgtcacagggaaaagtgggtccacagtgctacacgacactctctgatggcgcgagggaggc

SEQ ID NO: 853 - DNA, 495 bp, Artificial Sequence
  Synthetic Template Oligonucleotide for TCRB Locus
gccttgccagcccgctcagtgctacacttcggaactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacttcggaacgtcgactatggctacaccttcggttcggggaccaggttaaccgttgtaggtaaggctgggggtctctaggaggggtgcgatgagggaggactctgtcctgggaaattgctacacttcggaacctgatggcgcgagggaggc

SEQ ID NO: 854 - DNA, 495 bp, Artificial Sequence
  Synthetic Template Oligonucleotide for TCRB Locus
gccttgccagcccgctcagtgctacacaagtaacgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacaagtaacggtcgacgaaacaccatatattttggagagggaagttggctcactgttgtaggtgagtaagtcaaggctggacagctgggaacttgcaaaaaggggctggaatccagtgctacacaagtaacgctgatggcgcgagggaggc

SEQ ID NO: 855 - DNA, 495 bp, Artificial Sequence
  Synthetic Template Oligonucleotide for TCRB Locus
gccttgccagcccgctcagtgctacacgtctcctatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtctcctagtcgacaatgaaaaactgttttttggcagtggaacccagctctctgtcttgggtatgtaaaagacttctttcgggatagtgtatcataaggtcggagttccaggagtgctacacgtctcctactgatggcgcgagggaggc

SEQ ID NO: 856 - DNA, 495 bp, Artificial Sequence
  Synthetic Template Oligonucleotide for TCRB Locus
gccttgccagcccgctcagtgctacacagagtgtctccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacagagtgtcgtcgacatcagccccagcattttggtgatgggactcgactctccatcctaggtaagttgcagaatcagggtggtatggccattgtcccttgaaggcagagttctcttgctacacagagtgtcctgatggcgcgagggaggc

SEQ ID NO: 857 - DNA, 495 bp, Artificial Sequence
  Synthetic Template Oligonucleotide for TCRB Locus
gccttgccagcccgctcagtgctacacgttccgaatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgttccgaagtcgacataattcacccctccactttgggaacgggaccaggctcactgtgacaggtatgggggctccactcttgactcgggggtgcctgggtttgactgcaatgattgctacacgttccgaactgatggcgcgagggaggc

SEQ ID NO: 858 - DNA, 495 bp, Artificial Sequence
  Synthetic Template Oligonucleotide for TCRB Locus
gccttgccagcccgctcagtgctacaccgttactttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacaccgttacttgtcgacacaatgagcagttcttcgggccagggacacggctcaccgtgctaggtaagaagggggctccaggtgggagagagggtgagcagcccagcctgcacgaccctgctacaccgttacttctgatggcgcgagggaggc

SEQ ID NO: 859 - DNA, 495 bp, Artificial Sequence
  Synthetic Template Oligonucleotide for TCRB Locus
gccttgccagcccgctcagtgctacactaggagactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacactaggagacgtcgacaccggggagctgttttttggagaaggctctaggctgaccgtactgggtaaggaggcggttggggctccggagagctccgagagggcgggatgggcagaggtgctacactaggagacctgatggcgcgagggaggc

SEQ ID NO: 860 - DNA, 495 bp, Artificial Sequence
  Synthetic Template Oligonucleotide for TCRB Locus
gccttgccagcccgctcagtgctacacgtgtctactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtgtctacgtcgacagatacgcagtattttggcccaggcacccggctgacagtgctcggtaagcgggggctcccgctgaagccccggaactggggagggggcgccccgggacgctgctacacgtgtctacctgatggcgcgagggaggc

SEQ ID NO: 861 - DNA, 495 bp, Artificial Sequence
  Synthetic Template Oligonucleotide for TCRB Locus
gccttgccagcccgctcagtgctacacgtacagtgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtacagtggtcgacaaaacattcagtacttcggcgccgggacccggctctcagtgctgggtaagctggggccgccgggggaccggggacgagactgcgctcgggtttttgtgcgtgctacacgtacagtgctgatggcgcgagggaggc

SEQ ID NO: 862 - DNA, 495 bp, Artificial Sequence
  Synthetic Template Oligonucleotide for TCRB Locus
gccttgccagcccgctcagtgctacacggatcatctccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacggatcatcgtcgacgagacccagtacttcgggccaggcacgcggctcctggtgctcggtgagcgcgggctgctggggcgcgggcgcgggcggcttgggtctggtttttgcggggtgctacacggatcatcctgatggcgcgagggaggc

SEQ ID NO: 863 - DNA, 495 bp, Artificial Sequence
  Synthetic Template Oligonucleotide for TCRB Locus
gccttgccagcccgctcagtgctacactattggcgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacactattggcggtcgacgggccaacgtcctgactttcggggccggcagcaggctgaccgtgctgggtgagttttcgcgggaccacccgggcggcgggattcaggtggaaggcggcggtgctacactattggcgctgatggcgcgagggaggc

SEQ ID NO: 864 - DNA, 495 bp, Artificial Sequence
  Synthetic Template Oligonucleotide for TCRB Locus
gccttgccagcccgctcagtgctacacaggcttgatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacaggcttgagtcgacacgagcagtacttcgggccgggcaccaggctcacggtcacaggtgagattcgggcgtctccccaccttccagcccctcggtccccggagtcggagggtggtgctacacaggcttgactgatggcgcgagggaggc

SEQ ID NO: 865 - DNA, 495 bp, Artificial Sequence
  Synthetic Template Oligonucleotide for TCRB Locus
gccttgccagcccgctcagaactgccagacactcttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagacactctgtcgacactgaagctttctttggacaaggcaccagactcacagttgtaggtaagacatttttcaggttcttttgcagatccgtcacagggaaaagtgggtccacagaactgccagacactctctgatggcgcgagggaggc

SEQ ID NO: 866 - DNA, 495 bp, Artificial Sequence
  Synthetic Template Oligonucleotide for TCRB Locus
gccttgccagcccgctcagaactgccattcggaactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccattcggaacgtcgactatggctacaccttcggttcggggaccaggttaaccgttgtaggtaaggctgggggtctctaggaggggtgcgatgagggaggactctgtcctgggaaataactgccattcggaacctgatggcgcgagggaggc

SEQ ID NO: 867 - DNA, 495 bp, Artificial Sequence
  Synthetic Template Oligonucleotide for TCRB Locus
gccttgccagcccgctcagaactgccaaagtaacgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaaagtaacggtcgacgaaacaccatatattttggagagggaagttggctcactgttgtaggtgagtaagtcaaggctggacagctgggaacttgcaaaaaggggctggaatccagaactgccaaagtaacgctgatggcgcgagggaggc

SEQ ID NO: 868 - DNA, 495 bp, Artificial Sequence
  Synthetic Template Oligonucleotide for TCRB Locus
gccttgccagcccgctcagaactgccagtctcctatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtctcctagtcgacaatgaaaaactgttttttggcagtggaacccagctctctgtcttgggtatgtaaaagacttctttcgggatagtgtatcataaggtcggagttccaggagaactgccagtctcctactgatggcgcgagggaggc

SEQ ID NO: 869 - DNA, 495 bp, Artificial Sequence
  Synthetic Template Oligonucleotide for TCRB Locus
gccttgccagcccgctcagaactgccaagagtgtctccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaagagtgtcgtcgacatcagccccagcattttggtgatgggactcgactctccatcctaggtaagttgcagaatcagggtggtatggccattgtcccttgaaggcagagttctctaactgccaagagtgtcctgatggcgcgagggaggc

SEQ ID NO: 870 - DNA, 495 bp, Artificial Sequence
  Synthetic Template Oligonucleotide for TCRB Locus
gccttgccagcccgctcagaactgccagttccgaatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagttccgaagtcgacataattcacccctccactttgggaacgggaccaggctcactgtgacaggtatgggggctccactcttgactcgggggtgcctgggtttgactgcaatgataactgccagttccgaactgatggcgcgagggaggc

SEQ ID NO: 871 - DNA, 495 bp, Artificial Sequence
  Synthetic Template Oligonucleotide for TCRB Locus
gccttgccagcccgctcagaactgccacgttactttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccacgttacttgtcgacacaatgagcagttcttcgggccagggacacggctcaccgtgctaggtaagaagggggctccaggtgggagagagggtgagcagcccagcctgcacgacccaactgccacgttacttctgatggcgcgagggaggc

SEQ ID NO: 872 - DNA, 495 bp, Artificial Sequence
  Synthetic Template Oligonucleotide for TCRB Locus
gccttgccagcccgctcagaactgccataggagactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccataggagacgtcgacaccggggagctgttttttggagaaggctctaggctgaccgtactgggtaaggaggcggttggggctccggagagctccgagagggcgggatgggcagaggaactgccataggagacctgatggcgcgagggaggc

SEQ ID NO: 873 - DNA, 495 bp, Artificial Sequence
  Synthetic Template Oligonucleotide for TCRB Locus
gccttgccagcccgctcagaactgccagtgtctactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtgtctacgtcgacagatacgcagtattttggcccaggcacccggctgacagtgctcggtaagcgggggctcccgctgaagccccggaactggggagggggcgccccgggacgcaactgccagtgtctacctgatggcgcgagggaggc

SEQ ID NO: 874 - DNA, 495 bp, Artificial Sequence
  Synthetic Template Oligonucleotide for TCRB Locus
gccttgccagcccgctcagaactgccagtacagtgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtacagtggtcgacaaaacattcagtacttcggcgccgggacccggctctcagtgctgggtaagctggggccgccgggggaccggggacgagactgcgctcgggtttttgtgcgaactgccagtacagtgctgatggcgcgagggaggc

SEQ ID NO: 875 - DNA, 495 bp, Artificial Sequence
  Synthetic Template Oligonucleotide for TCRB Locus
gccttgccagcccgctcagaactgccaggatcatctccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaggatcatcgtcgacgagacccagtacttcgggccaggcacgcggctcctggtgctcggtgagcgcgggctgctggggcgcgggcgcgggcggcttgggtctggtttttgcggggaactgccaggatcatcctgatggcgcgagggaggc

SEQ ID NO: 876 - DNA, 495 bp, Artificial Sequence
  Synthetic Template Oligonucleotide for TCRB Locus
gccttgccagcccgctcagaactgccatattggcgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccatattggcggtcgacgggccaacgtcctgactttcggggccggcagcaggctgaccgtgctgggtgagttttcgcgggaccacccgggcggcgggattcaggtggaaggcggcggaactgccatattggcgctgatggcgcgagggaggc

SEQ ID NO: 877 - DNA, 495 bp, Artificial Sequence
  Synthetic Template Oligonucleotide for TCRB Locus
gccttgccagcccgctcagaactgccaaggcttgatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaaggcttgagtcgacacgagcagtacttcgggccgggcaccaggctcacggtcacaggtgagattcgggcgtctccccaccttccagcccctcggtccccggagtcggagggtggaactgccaaggcttgactgatggcgcgagggaggc

SEQ ID NO: 878 - DNA, 495 bp, Artificial Sequence
  Synthetic Template Oligonucleotide for TCRB Locus
gccttgccagcccgctcagttggactggacactctcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggacactctgtcgacactgaagctttctttggacaaggcaccagactcacagttgtaggtaagacatttttcaggttcttttgcagatccgtcacagggaaaagtgggtccacagttggactggacactctctgatggcgcgagggaggc

SEQ ID NO: 879 - DNA, 495 bp, Artificial Sequence
  Synthetic Template Oligonucleotide for TCRB Locus
gccttgccagcccgctcagttggactgttcggaaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgttcggaacgtcgactatggctacaccttcggttcggggaccaggttaaccgttgtaggtaaggctgggggtctctaggaggggtgcgatgagggaggactctgtcctgggaaatttggactgttcggaacctgatggcgcgagggaggc

SEQ ID NO: 880 - DNA, 495 bp, Artificial Sequence
  Synthetic Template Oligonucleotide for TCRB Locus
gccttgccagcccgctcagttggactgaagtaacgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgaagtaacggtcgacgaaacaccatatattttggagagggaagttggctcactgttgtaggtgagtaagtcaaggctggacagctgggaacttgcaaaaaggggctggaatccagttggactgaagtaacgctgatggcgcgagggaggc

SEQ ID NO: 881 - DNA, 495 bp, Artificial Sequence
  Synthetic Template Oligonucleotide for TCRB Locus
gccttgccagcccgctcagttggactggtctcctacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtctcctagtcgacaatgaaaaactgttttttggcagtggaacccagctctctgtcttgggtatgtaaaagacttctttcgggatagtgtatcataaggtcggagttccaggagttggactggtctcctactgatggcgcgagggaggc

SEQ ID NO: 882 - DNA, 495 bp, Artificial Sequence
  Synthetic Template Oligonucleotide for TCRB Locus
gccttgccagcccgctcagttggactgagagtgtccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgagagtgtcgtcgacatcagccccagcattttggtgatgggactcgactctccatcctaggtaagttgcagaatcagggtggtatggccattgtcccttgaaggcagagttctctttggactgagagtgtcctgatggcgcgagggaggc

SEQ ID NO: 883 - DNA, 495 bp, Artificial Sequence
  Synthetic Template Oligonucleotide for TCRB Locus
gccttgccagcccgctcagttggactggttccgaacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggttccgaagtcgacataattcacccctccactttgggaacgggaccaggctcactgtgacaggtatgggggctccactcttgactcgggggtgcctgggtttgactgcaatgatttggactggttccgaactgatggcgcgagggaggc

SEQ ID NO: 884 - DNA, 495 bp, Artificial Sequence
  Synthetic Template Oligonucleotide for TCRB Locus
gccttgccagcccgctcagttggactgcgttacttcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgcgttacttgtcgacacaatgagcagttcttcgggccagggacacggctcaccgtgctaggtaagaagggggctccaggtgggagagagggtgagcagcccagcctgcacgacccttggactgcgttacttctgatggcgcgagggaggc

SEQ ID NO: 885 - DNA, 495 bp, Artificial Sequence
  Synthetic Template Oligonucleotide for TCRB Locus
gccttgccagcccgctcagttggactgtaggagaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgtaggagacgtcgacaccggggagctgttttttggagaaggctctaggctgaccgtactgggtaaggaggcggttggggctccggagagctccgagagggcgggatgggcagaggttggactgtaggagacctgatggcgcgagggaggc

SEQ ID NO: 886 - DNA, 495 bp, Artificial Sequence
  Synthetic Template Oligonucleotide for TCRB Locus
gccttgccagcccgctcagttggactggtgtctaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtgtctacgtcgacagatacgcagtattttggcccaggcacccggctgacagtgctcggtaagcgggggctcccgctgaagccccggaactggggagggggcgccccgggacgcttggactggtgtctacctgatggcgcgagggaggc

SEQ ID NO: 887 - DNA, 495 bp, Artificial Sequence
  Synthetic Template Oligonucleotide for TCRB Locus
gccttgccagcccgctcagttggactggtacagtgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtacagtggtcgacaaaacattcagtacttcggcgccgggacccggctctcagtgctgggtaagctggggccgccgggggaccggggacgagactgcgctcgggtttttgtgcgttggactggtacagtgctgatggcgcgagggaggc

SEQ ID NO: 888 - DNA, 495 bp, Artificial Sequence
  Synthetic Template Oligonucleotide for TCRB Locus
gccttgccagcccgctcagttggactgggatcatccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgggatcatcgtcgacgagacccagtacttcgggccaggcacgcggctcctggtgctcggtgagcgcgggctgctggggcgcgggcgcgggcggcttgggtctggtttttgcggggttggactgggatcatcctgatggcgcgagggaggc

SEQ ID NO: 889 - DNA, 495 bp, Artificial Sequence
  Synthetic Template Oligonucleotide for TCRB Locus
gccttgccagcccgctcagttggactgtattggcgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgtattggcggtcgacgggccaacgtcctgactttcggggccggcagcaggctgaccgtgctgggtgagttttcgcgggaccacccgggcggcgggattcaggtggaaggcggcggttggactgtattggcgctgatggcgcgagggaggc

SEQ ID NO: 890 - DNA, 495 bp, Artificial Sequence
  Synthetic Template Oligonucleotide for TCRB Locus
gccttgccagcccgctcagttggactgaggcttgacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgaggcttgagtcgacacgagcagtacttcgggccgggcaccaggctcacggtcacaggtgagattcgggcgtctccccaccttccagcccctcggtccccggagtcggagggtggttggactgaggcttgactgatggcgcgagggaggc

SEQ ID NO: 891 - DNA, 495 bp, Artificial Sequence
  Synthetic Template Oligonucleotide for TCRB Locus
gccttgccagcccgctcaggtagacacgacactctttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgacactctgtcgacactgaagctttctttggacaaggcaccagactcacagttgtaggtaagacatttttcaggttcttttgcagatccgtcacagggaaaagtgggtccacaggtagacacgacactctctgatggcgcgagggaggc

SEQ ID NO: 892 - DNA, 495 bp, Artificial Sequence
  Synthetic Template Oligonucleotide for TCRB Locus
gccttgccagcccgctcaggtagacacttcggaacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacttcggaacgtcgactatggctacaccttcggttcggggaccaggttaaccgttgtaggtaaggctgggggtctctaggaggggtgcgatgagggaggactctgtcctgggaaatgtagacacttcggaacctgatggcgcgagggaggc

SEQ ID NO: 893 - DNA, 495 bp, Artificial Sequence
  Synthetic Template Oligonucleotide for TCRB Locus
gccttgccagcccgctcaggtagacacaagtaacgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacaagtaacggtcgacgaaacaccatatattttggagagggaagttggctcactgttgtaggtgagtaagtcaaggctggacagctgggaacttgcaaaaaggggctggaatccaggtagacacaagtaacgctgatggcgcgagggaggc

SEQ ID NO: 894 - DNA, 495 bp, Artificial Sequence
  Synthetic Template Oligonucleotide for TCRB Locus
gccttgccagcccgctcaggtagacacgtctcctattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtctcctagtcgacaatgaaaaactgttttttggcagtggaacccagctctctgtcttgggtatgtaaaagacttctttcgggatagtgtatcataaggtcggagttccaggaggtagacacgtctcctactgatggcgcgagggaggc

SEQ ID NO: 895 - DNA, 495 bp, Artificial Sequence
  Synthetic Template Oligonucleotide for TCRB Locus
gccttgccagcccgctcaggtagacacagagtgtcttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacagagtgtcgtcgacatcagccccagcattttggtgatgggactcgactctccatcctaggtaagttgcagaatcagggtggtatggccattgtcccttgaaggcagagttctctgtagacacagagtgtcctgatggcgcgagggaggc

SEQ ID NO: 896 - DNA, 495 bp, Artificial Sequence
  Synthetic Template Oligonucleotide for TCRB Locus
gccttgccagcccgctcaggtagacacgttccgaattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgttccgaagtcgacataattcacccctccactttgggaacgggaccaggctcactgtgacaggtatgggggctccactcttgactcgggggtgcctgggtttgactgcaatgatgtagacacgttccgaactgatggcgcgagggaggc

SEQ ID NO: 897 - DNA, 495 bp, Artificial Sequence
  Synthetic Template Oligonucleotide for TCRB Locus
gccttgccagcccgctcaggtagacaccgttacttttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacaccgttacttgtcgacacaatgagcagttcttcgggccagggacacggctcaccgtgctaggtaagaagggggctccaggtgggagagagggtgagcagcccagcctgcacgacccgtagacaccgttacttctgatggcgcgagggaggc

SEQ ID NO: 898 - DNA, 495 bp, Artificial Sequence
  Synthetic Template Oligonucleotide for TCRB Locus
gccttgccagcccgctcaggtagacactaggagacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacactaggagacgtcgacaccggggagctgttttttggagaaggctctaggctgaccgtactgggtaaggaggcggttggggctccggagagctccgagagggcgggatgggcagagggtagacactaggagacctgatggcgcgagggaggc

SEQ ID NO: 899 - DNA, 495 bp, Artificial Sequence
  Synthetic Template Oligonucleotide for TCRB Locus
gccttgccagcccgctcaggtagacacgtgtctacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtgtctacgtcgacagatacgcagtattttggcccaggcacccggctgacagtgctcggtaagcgggggctcccgctgaagccccggaactggggagggggcgccccgggacgcgtagacacgtgtctacctgatggcgcgagggaggc

SEQ ID NO: 900 - DNA, 495 bp, Artificial Sequence
  Synthetic Template Oligonucleotide for TCRB Locus
gccttgccagcccgctcaggtagacacgtacagtgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtacagtggtcgacaaaacattcagtacttcggcgccgggacccggctctcagtgctgggtaagctggggccgccgggggaccggggacgagactgcgctcgggtttttgtgcggtagacacgtacagtgctgatggcgcgagggaggc

SEQ ID NO: 901 - DNA, 495 bp, Artificial Sequence
  Synthetic Template Oligonucleotide for TCRB Locus
gccttgccagcccgctcaggtagacacggatcatcttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacggatcatcgtcgacgagacccagtacttcgggccaggcacgcggctcctggtgctcggtgagcgcgggctgctggggcgcgggcgcgggcggcttgggtctggtttttgcgggggtagacacggatcatcctgatggcgcgagggaggc

SEQ ID NO: 902 - DNA, 495 bp, Artificial Sequence
  Synthetic Template Oligonucleotide for TCRB Locus
gccttgccagcccgctcaggtagacactattggcgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacactattggcggtcgacgggccaacgtcctgactttcggggccggcagcaggctgaccgtgctgggtgagttttcgcgggaccacccgggcggcgggattcaggtggaaggcggcgggtagacactattggcgctgatggcgcgagggaggc

SEQ ID NO: 903 - DNA, 495 bp, Artificial Sequence
  Synthetic Template Oligonucleotide for TCRB Locus
gccttgccagcccgctcaggtagacacaggcttgattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacaggcttgagtcgacacgagcagtacttcgggccgggcaccaggctcacggtcacaggtgagattcgggcgtctccccaccttccagcccctcggtccccggagtcggagggtgggtagacacaggcttgactgatggcgcgagggaggc

SEQ ID NO: 904 - DNA, 495 bp, Artificial Sequence
  Synthetic Template Oligonucleotide for TCRB Locus
gccttgccagcccgctcagcactgtacgacactctcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgacactctgtcgacactgaagctttctttggacaaggcaccagactcacagttgtaggtaagacatttttcaggttcttttgcagatccgtcacagggaaaagtgggtccacagcactgtacgacactctctgatggcgcgagggaggc

SEQ ID NO: 905 - DNA, 495 bp, Artificial Sequence
  Synthetic Template Oligonucleotide for TCRB Locus
gccttgccagcccgctcagcactgtacttcggaaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacttcggaacgtcgactatggctacaccttcggttcggggaccaggttaaccgttgtaggtaaggctgggggtctctaggaggggtgcgatgagggaggactctgtcctgggaaatcactgtacttcggaacctgatggcgcgagggaggc

SEQ ID NO: 906 - DNA, 495 bp, Artificial Sequence
  Synthetic Template Oligonucleotide for TCRB Locus
gccttgccagcccgctcagcactgtacaagtaacgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacaagtaacggtcgacgaaacaccatatattttggagagggaagttggctcactgttgtaggtgagtaagtcaaggctggacagctgggaacttgcaaaaaggggctggaatccagcactgtacaagtaacgctgatggcgcgagggaggc

SEQ ID NO: 907 - DNA, 495 bp, Artificial Sequence
  Synthetic Template Oligonucleotide for TCRB Locus
gccttgccagcccgctcagcactgtacgtctcctacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtctcctagtcgacaatgaaaaactgttttttggcagtggaacccagctctctgtcttgggtatgtaaaagacttctttcgggatagtgtatcataaggtcggagttccaggagcactgtacgtctcctactgatggcgcgagggaggc

SEQ ID NO: 908 - DNA, 495 bp, Artificial Sequence
  Synthetic Template Oligonucleotide for TCRB Locus
gccttgccagcccgctcagcactgtacagagtgtccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacagagtgtcgtcgacatcagccccagcattttggtgatgggactcgactctccatcctaggtaagttgcagaatcagggtggtatggccattgtcccttgaaggcagagttctctcactgtacagagtgtcctgatggcgcgagggaggc

SEQ ID NO: 909 - DNA, 495 bp, Artificial Sequence
  Synthetic Template Oligonucleotide for TCRB Locus
gccttgccagcccgctcagcactgtacgttccgaacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgttccgaagtcgacataattcacccctccactttgggaacgggaccaggctcactgtgacaggtatgggggctccactcttgactcgggggtgcctgggtttgactgcaatgatcactgtacgttccgaactgatggcgcgagggaggc

SEQ ID NO: 910 - DNA, 495 bp, Artificial Sequence
  Synthetic Template Oligonucleotide for TCRB Locus
gccttgccagcccgctcagcactgtaccgttacttcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtaccgttacttgtcgacacaatgagcagttcttcgggccagggacacggctcaccgtgctaggtaagaagggggctccaggtgggagagagggtgagcagcccagcctgcacgaccccactgtaccgttacttctgatggcgcgagggaggc

SEQ ID NO: 911 - DNA, 495 bp, Artificial Sequence
  Synthetic Template Oligonucleotide for TCRB Locus
gccttgccagcccgctcagcactgtactaggagaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtactaggagacgtcgacaccggggagctgttttttggagaaggctctaggctgaccgtactgggtaaggaggcggttggggctccggagagctccgagagggcgggatgggcagaggcactgtactaggagacctgatggcgcgagggaggc

SEQ ID NO: 912 - DNA, 495 bp, Artificial Sequence
  Synthetic Template Oligonucleotide for TCRB Locus
gccttgccagcccgctcagcactgtacgtgtctaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtgtctacgtcgacagatacgcagtattttggcccaggcacccggctgacagtgctcggtaagcgggggctcccgctgaagccccggaactggggagggggcgccccgggacgccactgtacgtgtctacctgatggcgcgagggaggc

SEQ ID NO: 913 - DNA, 495 bp, Artificial Sequence
  Synthetic Template Oligonucleotide for TCRB Locus
gccttgccagcccgctcagcactgtacgtacagtgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtacagtggtcgacaaaacattcagtacttcggcgccgggacccggctctcagtgctgggtaagctggggccgccgggggaccggggacgagactgcgctcgggtttttgtgcgcactgtacgtacagtgctgatggcgcgagggaggc

SEQ ID NO: 914 - DNA, 495 bp, Artificial Sequence
  Synthetic Template Oligonucleotide for TCRB Locus
gccttgccagcccgctcagcactgtacggatcatccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacggatcatcgtcgacgagacccagtacttcgggccaggcacgcggctcctggtgctcggtgagcgcgggctgctggggcgcgggcgcgggcggcttgggtctggtttttgcggggcactgtacggatcatcctgatggcgcgagggaggc

SEQ ID NO: 915 - DNA, 495 bp, Artificial Sequence
  Synthetic Template Oligonucleotide for TCRB Locus
gccttgccagcccgctcagcactgtactattggcgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtactattggcggtcgacgggccaacgtcctgactttcggggccggcagcaggctgaccgtgctgggtgagttttcgcgggaccacccgggcggcgggattcaggtggaaggcggcggcactgtactattggcgctgatggcgcgagggaggc

SEQ ID NO: 916 - DNA, 495 bp, Artificial Sequence
  Synthetic Template Oligonucleotide for TCRB Locus
gccttgccagcccgctcagcactgtacaggcttgacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacaggcttgagtcgacacgagcagtacttcgggccgggcaccaggctcacggtcacaggtgagattcgggcgtctccccaccttccagcccctcggtccccggagtcggagggtggcactgtacaggcttgactgatggcgcgagggaggc

SEQ ID NO: 917 - DNA, 495 bp, Artificial Sequence
  Synthetic Template Oligonucleotide for TCRB Locus
gccttgccagcccgctcaggatgatccgacactctcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgacactctgtcgacactgaagctttctttggacaaggcaccagactcacagttgtaggtaagacatttttcaggttcttttgcagatccgtcacagggaaaagtgggtccacaggatgatccgacactctctgatggcgcgagggaggc

SEQ ID NO: 918 - DNA, 495 bp, Artificial Sequence
  Synthetic Template Oligonucleotide for TCRB Locus
gccttgccagcccgctcaggatgatccttcggaaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccttcggaacgtcgactatggctacaccttcggttcggggaccaggttaaccgttgtaggtaaggctgggggtctctaggaggggtgcgatgagggaggactctgtcctgggaaatgatgatccttcggaacctgatggcgcgagggaggc

SEQ ID NO: 919 - DNA, 495 bp, Artificial Sequence
  Synthetic Template Oligonucleotide for TCRB Locus
gccttgccagcccgctcaggatgatccaagtaacgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccaagtaacggtcgacgaaacaccatatattttggagagggaagttggctcactgttgtaggtgagtaagtcaaggctggacagctgggaacttgcaaaaaggggctggaatccaggatgatccaagtaacgctgatggcgcgagggaggc

SEQ ID NO: 920 - DNA, 495 bp, Artificial Sequence
  Synthetic Template Oligonucleotide for TCRB Locus
gccttgccagcccgctcaggatgatccgtctcctacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtctcctagtcgacaatgaaaaactgttttttggcagtggaacccagctctctgtcttgggtatgtaaaagacttctttcgggatagtgtatcataaggtcggagttccaggaggatgatccgtctcctactgatggcgcgagggaggc

SEQ ID NO: 921 - DNA, 495 bp, Artificial Sequence
  Synthetic Template Oligonucleotide for TCRB Locus
gccttgccagcccgctcaggatgatccagagtgtccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccagagtgtcgtcgacatcagccccagcattttggtgatgggactcgactctccatcctaggtaagttgcagaatcagggtggtatggccattgtcccttgaaggcagagttctctgatgatccagagtgtcctgatggcgcgagggaggc

SEQ ID NO: 922 - DNA, 495 bp, Artificial Sequence
  Synthetic Template Oligonucleotide for TCRB Locus
gccttgccagcccgctcaggatgatccgttccgaacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgttccgaagtcgacataattcacccctccactttgggaacgggaccaggctcactgtgacaggtatgggggctccactcttgactcgggggtgcctgggtttgactgcaatgatgatgatccgttccgaactgatggcgcgagggaggc

SEQ ID NO: 923 - DNA, 495 bp, Artificial Sequence
  Synthetic Template Oligonucleotide for TCRB Locus
gccttgccagcccgctcaggatgatcccgttacttcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcccgttacttgtcgacacaatgagcagttcttcgggccagggacacggctcaccgtgctaggtaagaagggggctccaggtgggagagagggtgagcagcccagcctgcacgacccgatgatcccgttacttctgatggcgcgagggaggc

SEQ ID NO: 924 - DNA, 495 bp, Artificial Sequence
  Synthetic Template Oligonucleotide for TCRB Locus
gccttgccagcccgctcaggatgatcctaggagaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcctaggagacgtcgacaccggggagctgttttttggagaaggctctaggctgaccgtactgggtaaggaggcggttggggctccggagagctccgagagggcgggatgggcagagggatgatcctaggagacctgatggcgcgagggaggc

SEQ ID NO: 925 - DNA, 495 bp, Artificial Sequence
  Synthetic Template Oligonucleotide for TCRB Locus
gccttgccagcccgctcaggatgatccgtgtctaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtgtctacgtcgacagatacgcagtattttggcccaggcacccggctgacagtgctcggtaagcgggggctcccgctgaagccccggaactggggagggggcgccccgggacgcgatgatccgtgtctacctgatggcgcgagggaggc

SEQ ID NO: 926 - DNA, 495 bp, Artificial Sequence
  Synthetic Template Oligonucleotide for TCRB Locus
gccttgccagcccgctcaggatgatccgtacagtgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtacagtggtcgacaaaacattcagtacttcggcgccgggacccggctctcagtgctgggtaagctggggccgccgggggaccggggacgagactgcgctcgggtttttgtgcggatgatccgtacagtgctgatggcgcgagggaggc

SEQ ID NO: 927 - DNA, 495 bp, Artificial Sequence
  Synthetic Template Oligonucleotide for TCRB Locus
gccttgccagcccgctcaggatgatccggatcatccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccggatcatcgtcgacgagacccagtacttcgggccaggcacgcggctcctggtgctcggtgagcgcgggctgctggggcgcgggcgcgggcggcttgggtctggtttttgcgggggatgatccggatcatcctgatggcgcgagggaggc

SEQ ID NO: 928 - DNA, 495 bp, Artificial Sequence
  Synthetic Template Oligonucleotide for TCRB Locus
gccttgccagcccgctcaggatgatcctattggcgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcctattggcggtcgacgggccaacgtcctgactttcggggccggcagcaggctgaccgtgctgggtgagttttcgcgggaccacccgggcggcgggattcaggtggaaggcggcgggatgatcctattggcgctgatggcgcgagggaggc

SEQ ID NO: 929 - DNA, 495 bp, Artificial Sequence
  Synthetic Template Oligonucleotide for TCRB Locus
gccttgccagcccgctcaggatgatccaggcttgacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccaggcttgagtcgacacgagcagtacttcgggccgggcaccaggctcacggtcacaggtgagattcgggcgtctccccaccttccagcccctcggtccccggagtcggagggtgggatgatccaggcttgactgatggcgcgagggaggc

SEQ ID NO: 930 - DNA, 495 bp, Artificial Sequence
  Synthetic Template Oligonucleotide for TCRB Locus
gccttgccagcccgctcagcgccaatagacactctcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagacactctgtcgacactgaagctttctttggacaaggcaccagactcacagttgtaggtaagacatttttcaggttcttttgcagatccgtcacagggaaaagtgggtccacagcgccaatagacactctctgatggcgcgagggaggc

SEQ ID NO: 931 - DNA, 495 bp, Artificial Sequence
  Synthetic Template Oligonucleotide for TCRB Locus
gccttgccagcccgctcagcgccaatattcggaaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatattcggaacgtcgactatggctacaccttcggttcggggaccaggttaaccgttgtaggtaaggctgggggtctctaggaggggtgcgatgagggaggactctgtcctgggaaatcgccaatattcggaacctgatggcgcgagggaggc

SEQ ID NO: 932 - DNA, 495 bp, Artificial Sequence
  Synthetic Template Oligonucleotide for TCRB Locus
gccttgccagcccgctcagcgccaataaagtaacgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataaagtaacggtcgacgaaacaccatatattttggagagggaagttggctcactgttgtaggtgagtaagtcaaggctggacagctgggaacttgcaaaaaggggctggaatccagcgccaataaagtaacgctgatggcgcgagggaggc

SEQ ID NO: 933 - DNA, 495 bp, Artificial Sequence
  Synthetic Template Oligonucleotide for TCRB Locus
gccttgccagcccgctcagcgccaatagtctcctacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtctcctagtcgacaatgaaaaactgttttttggcagtggaacccagctctctgtcttgggtatgtaaaagacttctttcgggatagtgtatcataaggtcggagttccaggagcgccaatagtctcctactgatggcgcgagggaggc

SEQ ID NO: 934 - DNA, 495 bp, Artificial Sequence
  Synthetic Template Oligonucleotide for TCRB Locus
gccttgccagcccgctcagcgccaataagagtgtccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataagagtgtcgtcgacatcagccccagcattttggtgatgggactcgactctccatcctaggtaagttgcagaatcagggtggtatggccattgtcccttgaaggcagagttctctcgccaataagagtgtcctgatggcgcgagggaggc

SEQ ID NO: 935 - DNA, 495 bp, Artificial Sequence
  Synthetic Template Oligonucleotide for TCRB Locus
gccttgccagcccgctcagcgccaatagttccgaacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagttccgaagtcgacataattcacccctccactttgggaacgggaccaggctcactgtgacaggtatgggggctccactcttgactcgggggtgcctgggtttgactgcaatgatcgccaatagttccgaactgatggcgcgagggaggc

SEQ ID NO: 936 - DNA, 495 bp, Artificial Sequence
  Synthetic Template Oligonucleotide for TCRB Locus
gccttgccagcccgctcagcgccaatacgttacttcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatacgttacttgtcgacacaatgagcagttcttcgggccagggacacggctcaccgtgctaggtaagaagggggctccaggtgggagagagggtgagcagcccagcctgcacgaccccgccaatacgttacttctgatggcgcgagggaggc

SEQ ID NO: 937 - DNA, 495 bp, Artificial Sequence
  Synthetic Template Oligonucleotide for TCRB Locus
gccttgccagcccgctcagcgccaatataggagaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatataggagacgtcgacaccggggagctgttttttggagaaggctctaggctgaccgtactgggtaaggaggcggttggggctccggagagctccgagagggcgggatgggcagaggcgccaatataggagacctgatggcgcgagggaggc

SEQ ID NO: 938 - DNA, 495 bp, Artificial Sequence
  Synthetic Template Oligonucleotide for TCRB Locus
gccttgccagcccgctcagcgccaatagtgtctaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtgtctacgtcgacagatacgcagtattttggcccaggcacccggctgacagtgctcggtaagcgggggctcccgctgaagccccggaactggggagggggcgccccgggacgccgccaatagtgtctacctgatggcgcgagggaggc

SEQ ID NO: 939 - DNA, 495 bp, Artificial Sequence
  Synthetic Template Oligonucleotide for TCRB Locus
gccttgccagcccgctcagcgccaatagtacagtgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtacagtggtcgacaaaacattcagtacttcggcgccgggacccggctctcagtgctgggtaagctggggccgccgggggaccggggacgagactgcgctcgggtttttgtgcgcgccaatagtacagtgctgatggcgcgagggaggc

SEQ ID NO: 940 - DNA, 495 bp, Artificial Sequence
  Synthetic Template Oligonucleotide for TCRB Locus
gccttgccagcccgctcagcgccaataggatcatccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataggatcatcgtcgacgagacccagtacttcgggccaggcacgcggctcctggtgctcggtgagcgcgggctgctggggcgcgggcgcgggcggcttgggtctggtttttgcggggcgccaataggatcatcctgatggcgcgagggaggc

SEQ ID NO: 941 - DNA, 495 bp, Artificial Sequence
  Synthetic Template Oligonucleotide for TCRB Locus
gccttgccagcccgctcagcgccaatatattggcgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatatattggcggtcgacgggccaacgtcctgactttcggggccggcagcaggctgaccgtgctgggtgagttttcgcgggaccacccgggcggcgggattcaggtggaaggcggcggcgccaatatattggcgctgatggcgcgagggaggc

SEQ ID NO: 942 - DNA, 495 bp, Artificial Sequence
  Synthetic Template Oligonucleotide for TCRB Locus
gccttgccagcccgctcagcgccaataaggcttgacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataaggcttgagtcgacacgagcagtacttcgggccgggcaccaggctcacggtcacaggtgagattcgggcgtctccccaccttccagcccctcggtccccggagtcggagggtggcgccaataaggcttgactgatggcgcgagggaggc

SEQ ID NO: 943 - DNA, 495 bp, Artificial Sequence
  Synthetic Template Oligonucleotide for TCRB Locus
gccttgccagcccgctcagtcaagcctgacactctcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgacactctgtcgacactgaagctttctttggacaaggcaccagactcacagttgtaggtaagacatttttcaggttcttttgcagatccgtcacagggaaaagtgggtccacagtcaagcctgacactctctgatggcgcgagggaggc

SEQ ID NO: 944 - DNA, 495 bp, Artificial Sequence
  Synthetic Template Oligonucleotide for TCRB Locus
gccttgccagcccgctcagtcaagcctttcggaaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctttcggaacgtcgactatggctacaccttcggttcggggaccaggttaaccgttgtaggtaaggctgggggtctctaggaggggtgcgatgagggaggactctgtcctgggaaattcaagcctttcggaacctgatggcgcgagggaggc

SEQ ID NO: 945 - DNA, 495 bp, Artificial Sequence
  Synthetic Template Oligonucleotide for TCRB Locus
gccttgccagcccgctcagtcaagcctaagtaacgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctaagtaacggtcgacgaaacaccatatattttggagagggaagttggctcactgttgtaggtgagtaagtcaaggctggacagctgggaacttgcaaaaaggggctggaatccagtcaagcctaagtaacgctgatggcgcgagggaggc

SEQ ID NO: 946 - DNA, 495 bp, Artificial Sequence
  Synthetic Template Oligonucleotide for TCRB Locus
gccttgccagcccgctcagtcaagcctgtctcctacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtctcctagtcgacaatgaaaaactgttttttggcagtggaacccagctctctgtcttgggtatgtaaaagacttctttcgggatagtgtatcataaggtcggagttccaggagtcaagcctgtctcctactgatggcgcgagggaggc

SEQ ID NO: 947 - DNA, 495 bp, Artificial Sequence
  Synthetic Template Oligonucleotide for TCRB Locus
gccttgccagcccgctcagtcaagcctagagtgtccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctagagtgtcgtcgacatcagccccagcattttggtgatgggactcgactctccatcctaggtaagttgcagaatcagggtggtatggccattgtcccttgaaggcagagttctcttcaagcctagagtgtcctgatggcgcgagggaggc

SEQ ID NO: 948 - DNA, 495 bp, Artificial Sequence
  Synthetic Template Oligonucleotide for TCRB Locus
gccttgccagcccgctcagtcaagcctgttccgaacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgttccgaagtcgacataattcacccctccactttgggaacgggaccaggctcactgtgacaggtatgggggctccactcttgactcgggggtgcctgggtttgactgcaatgattcaagcctgttccgaactgatggcgcgagggaggc

SEQ ID NO: 949 - DNA, 495 bp, Artificial Sequence
  Synthetic Template Oligonucleotide for TCRB Locus
gccttgccagcccgctcagtcaagcctcgttacttcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctcgttacttgtcgacacaatgagcagttcttcgggccagggacacggctcaccgtgctaggtaagaagggggctccaggtgggagagagggtgagcagcccagcctgcacgaccctcaagcctcgttacttctgatggcgcgagggaggc

SEQ ID NO: 950 - DNA, 495 bp, Artificial Sequence
  Synthetic Template Oligonucleotide for TCRB Locus
gccttgccagcccgctcagtcaagccttaggagaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagccttaggagacgtcgacaccggggagctgttttttggagaaggctctaggctgaccgtactgggtaaggaggcggttggggctccggagagctccgagagggcgggatgggcagaggtcaagccttaggagacctgatggcgcgagggaggc

SEQ ID NO: 951 - DNA, 495 bp, Artificial Sequence
  Synthetic Template Oligonucleotide for TCRB Locus
gccttgccagcccgctcagtcaagcctgtgtctaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtgtctacgtcgacagatacgcagtattttggcccaggcacccggctgacagtgctcggtaagcgggggctcccgctgaagccccggaactggggagggggcgccccgggacgctcaagcctgtgtctacctgatggcgcgagggaggc

SEQ ID NO: 952 - DNA, 495 bp, Artificial Sequence
  Synthetic Template Oligonucleotide for TCRB Locus
gccttgccagcccgctcagtcaagcctgtacagtgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtacagtggtcgacaaaacattcagtacttcggcgccgggacccggctctcagtgctgggtaagctggggccgccgggggaccggggacgagactgcgctcgggtttttgtgcgtcaagcctgtacagtgctgatggcgcgagggaggc

SEQ ID NO: 953 - DNA, 495 bp, Artificial Sequence
  Synthetic Template Oligonucleotide for TCRB Locus
gccttgccagcccgctcagtcaagcctggatcatccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctggatcatcgtcgacgagacccagtacttcgggccaggcacgcggctcctggtgctcggtgagcgcgggctgctggggcgcgggcgcgggcggcttgggtctggtttttgcggggtcaagcctggatcatcctgatggcgcgagggaggc

SEQ ID NO: 954 - DNA, 495 bp, Artificial Sequence
  Synthetic Template Oligonucleotide for TCRB Locus
gccttgccagcccgctcagtcaagccttattggcgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagccttattggcggtcgacgggccaacgtcctgactttcggggccggcagcaggctgaccgtgctgggtgagttttcgcgggaccacccgggcggcgggattcaggtggaaggcggcggtcaagccttattggcgctgatggcgcgagggaggc

SEQ ID NO: 955 - DNA, 495 bp, Artificial Sequence
  Synthetic Template Oligonucleotide for TCRB Locus
gccttgccagcccgctcagtcaagcctaggcttgacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctaggcttgagtcgacacgagcagtacttcgggccgggcaccaggctcacggtcacaggtgagattcgggcgtctccccaccttccagcccctcggtccccggagtcggagggtggtcaagcctaggcttgactgatggcgcgagggaggc

SEQ ID NO: 956 - DNA, 495 bp, Artificial Sequence
  Synthetic Template Oligonucleotide for TCRB Locus
gccttgccagcccgctcagacgtgtgtgacactctcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgacactctgtcgacactgaagctttctttggacaaggcaccagactcacagttgtaggtaagacatttttcaggttcttttgcagatccgtcacagggaaaagtgggtccacagacgtgtgtgacactctctgatggcgcgagggaggc

SEQ ID NO: 957 - DNA, 495 bp, Artificial Sequence
  Synthetic Template Oligonucleotide for TCRB Locus
gccttgccagcccgctcagacgtgtgtttcggaaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtttcggaacgtcgactatggctacaccttcggttcggggaccaggttaaccgttgtaggtaaggctgggggtctctaggaggggtgcgatgagggaggactctgtcctgggaaatacgtgtgtttcggaacctgatggcgcgagggaggc

SEQ ID NO: 958 - DNA, 495 bp, Artificial Sequence
  Synthetic Template Oligonucleotide for TCRB Locus
gccttgccagcccgctcagacgtgtgtaagtaacgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtaagtaacggtcgacgaaacaccatatattttggagagggaagttggctcactgttgtaggtgagtaagtcaaggctggacagctgggaacttgcaaaaaggggctggaatccagacgtgtgtaagtaacgctgatggcgcgagggaggc

SEQ ID NO: 959 - DNA, 495 bp, Artificial Sequence
  Synthetic Template Oligonucleotide for TCRB Locus
gccttgccagcccgctcagacgtgtgtgtctcctacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtctcctagtcgacaatgaaaaactgttttttggcagtggaacccagctctctgtcttgggtatgtaaaagacttctttcgggatagtgtatcataaggtcggagttccaggagacgtgtgtgtctcctactgatggcgcgagggaggc

SEQ ID NO: 960 - DNA, 495 bp, Artificial Sequence
  Synthetic Template Oligonucleotide for TCRB Locus
gccttgccagcccgctcagacgtgtgtagagtgtccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtagagtgtcgtcgacatcagccccagcattttggtgatgggactcgactctccatcctaggtaagttgcagaatcagggtggtatggccattgtcccttgaaggcagagttctctacgtgtgtagagtgtcctgatggcgcgagggaggc

SEQ ID NO: 961 - DNA, 495 bp, Artificial Sequence
  Synthetic Template Oligonucleotide for TCRB Locus
gccttgccagcccgctcagacgtgtgtgttccgaacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgttccgaagtcgacataattcacccctccactttgggaacgggaccaggctcactgtgacaggtatgggggctccactcttgactcgggggtgcctgggtttgactgcaatgatacgtgtgtgttccgaactgatggcgcgagggaggc

SEQ ID NO: 962 - DNA, 495 bp, Artificial Sequence
  Synthetic Template Oligonucleotide for TCRB Locus
gccttgccagcccgctcagacgtgtgtcgttacttcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtcgttacttgtcgacacaatgagcagttcttcgggccagggacacggctcaccgtgctaggtaagaagggggctccaggtgggagagagggtgagcagcccagcctgcacgacccacgtgtgtcgttacttctgatggcgcgagggaggc

SEQ ID NO: 963 - DNA, 495 bp, Artificial Sequence
  Synthetic Template Oligonucleotide for TCRB Locus
gccttgccagcccgctcagacgtgtgttaggagaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgttaggagacgtcgacaccggggagctgttttttggagaaggctctaggctgaccgtactgggtaaggaggcggttggggctccggagagctccgagagggcgggatgggcagaggacgtgtgttaggagacctgatggcgcgagggaggc

SEQ ID NO: 964 - DNA, 495 bp, Artificial Sequence
  Synthetic Template Oligonucleotide for TCRB Locus
gccttgccagcccgctcagacgtgtgtgtgtctaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtgtctacgtcgacagatacgcagtattttggcccaggcacccggctgacagtgctcggtaagcgggggctcccgctgaagccccggaactggggagggggcgccccgggacgcacgtgtgtgtgtctacctgatggcgcgagggaggc

SEQ ID NO: 965 - DNA, 495 bp, Artificial Sequence
  Synthetic Template Oligonucleotide for TCRB Locus
gccttgccagcccgctcagacgtgtgtgtacagtgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtacagtggtcgacaaaacattcagtacttcggcgccgggacccggctctcagtgctgggtaagctggggccgccgggggaccggggacgagactgcgctcgggtttttgtgcgacgtgtgtgtacagtgctgatggcgcgagggaggc

SEQ ID NO: 966 - DNA, 495 bp, Artificial Sequence
  Synthetic Template Oligonucleotide for TCRB Locus
gccttgccagcccgctcagacgtgtgtggatcatccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtggatcatcgtcgacgagacccagtacttcgggccaggcacgcggctcctggtgctcggtgagcgcgggctgctggggcgcgggcgcgggcggcttgggtctggtttttgcggggacgtgtgtggatcatcctgatggcgcgagggaggc

SEQ ID NO: 967 - DNA, 495 bp, Artificial Sequence
  Synthetic Template Oligonucleotide for TCRB Locus
gccttgccagcccgctcagacgtgtgttattggcgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgttattggcggtcgacgggccaacgtcctgactttcggggccggcagcaggctgaccgtgctgggtgagttttcgcgggaccacccgggcggcgggattcaggtggaaggcggcggacgtgtgttattggcgctgatggcgcgagggaggc

SEQ ID NO: 968 - DNA, 495 bp, Artificial Sequence
  Synthetic Template Oligonucleotide for TCRB Locus
gccttgccagcccgctcagacgtgtgtaggcttgacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtaggcttgagtcgacacgagcagtacttcgggccgggcaccaggctcacggtcacaggtgagattcgggcgtctccccaccttccagcccctcggtccccggagtcggagggtggacgtgtgtaggcttgactgatggcgcgagggaggc

SEQ ID NO: 969 - DNA, 495 bp, Artificial Sequence
  Synthetic Template Oligonucleotide for TCRB Locus
gccttgccagcccgctcagtccgtctagacactctcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagacactctgtcgacactgaagctttctttggacaaggcaccagactcacagttgtaggtaagacatttttcaggttcttttgcagatccgtcacagggaaaagtgggtccacagtccgtctagacactctctgatggcgcgagggaggc

SEQ ID NO: 970 - DNA, 495 bp, Artificial Sequence
  Synthetic Template Oligonucleotide for TCRB Locus
gccttgccagcccgctcagtccgtctattcggaaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctattcggaacgtcgactatggctacaccttcggttcggggaccaggttaaccgttgtaggtaaggctgggggtctctaggaggggtgcgatgagggaggactctgtcctgggaaattccgtctattcggaacctgatggcgcgagggaggc

SEQ ID NO: 971 - DNA, 495 bp, Artificial Sequence
  Synthetic Template Oligonucleotide for TCRB Locus
gccttgccagcccgctcagtccgtctaaagtaacgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaaagtaacggtcgacgaaacaccatatattttggagagggaagttggctcactgttgtaggtgagtaagtcaaggctggacagctgggaacttgcaaaaaggggctggaatccagtccgtctaaagtaacgctgatggcgcgagggaggc

SEQ ID NO: 972 - DNA, 495 bp, Artificial Sequence
  Synthetic Template Oligonucleotide for TCRB Locus
gccttgccagcccgctcagtccgtctagtctcctacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtctcctagtcgacaatgaaaaactgttttttggcagtggaacccagctctctgtcttgggtatgtaaaagacttctttcgggatagtgtatcataaggtcggagttccaggagtccgtctagtctcctactgatggcgcgagggaggc

SEQ ID NO: 973 - DNA, 495 bp, Artificial Sequence
  Synthetic Template Oligonucleotide for TCRB Locus
gccttgccagcccgctcagtccgtctaagagtgtccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaagagtgtcgtcgacatcagccccagcattttggtgatgggactcgactctccatcctaggtaagttgcagaatcagggtggtatggccattgtcccttgaaggcagagttctcttccgtctaagagtgtcctgatggcgcgagggaggc

SEQ ID NO: 974 - DNA, 495 bp, Artificial Sequence
  Synthetic Template Oligonucleotide for TCRB Locus
gccttgccagcccgctcagtccgtctagttccgaacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagttccgaagtcgacataattcacccctccactttgggaacgggaccaggctcactgtgacaggtatgggggctccactcttgactcgggggtgcctgggtttgactgcaatgattccgtctagttccgaactgatggcgcgagggaggc

SEQ ID NO: 975 - DNA, 495 bp, Artificial Sequence
  Synthetic Template Oligonucleotide for TCRB Locus
gccttgccagcccgctcagtccgtctacgttacttcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctacgttacttgtcgacacaatgagcagttcttcgggccagggacacggctcaccgtgctaggtaagaagggggctccaggtgggagagagggtgagcagcccagcctgcacgaccctccgtctacgttacttctgatggcgcgagggaggc

SEQ ID NO: 976 - DNA, 495 bp, Artificial Sequence
  Synthetic Template Oligonucleotide for TCRB Locus
gccttgccagcccgctcagtccgtctataggagaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctataggagacgtcgacaccggggagctgttttttggagaaggctctaggctgaccgtactgggtaaggaggcggttggggctccggagagctccgagagggcgggatgggcagaggtccgtctataggagacctgatggcgcgagggaggc

SEQ ID NO: 977 - DNA, 495 bp, Artificial Sequence
  Synthetic Template Oligonucleotide for TCRB Locus
gccttgccagcccgctcagtccgtctagtgtctaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtgtctacgtcgacagatacgcagtattttggcccaggcacccggctgacagtgctcggtaagcgggggctcccgctgaagccccggaactggggagggggcgccccgggacgctccgtctagtgtctacctgatggcgcgagggaggc

SEQ ID NO: 978 - DNA, 495 bp, Artificial Sequence
  Synthetic Template Oligonucleotide for TCRB Locus
gccttgccagcccgctcagtccgtctagtacagtgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtacagtggtcgacaaaacattcagtacttcggcgccgggacccggctctcagtgctgggtaagctggggccgccgggggaccggggacgagactgcgctcgggtttttgtgcgtccgtctagtacagtgctgatggcgcgagggaggc

SEQ ID NO: 979 - DNA, 495 bp, Artificial Sequence
  Synthetic Template Oligonucleotide for TCRB Locus
gccttgccagcccgctcagtccgtctaggatcatccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaggatcatcgtcgacgagacccagtacttcgggccaggcacgcggctcctggtgctcggtgagcgcgggctgctggggcgcgggcgcgggcggcttgggtctggtttttgcggggtccgtctaggatcatcctgatggcgcgagggaggc

SEQ ID NO: 980 - DNA, 495 bp, Artificial Sequence
  Synthetic Template Oligonucleotide for TCRB Locus
gccttgccagcccgctcagtccgtctatattggcgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctatattggcggtcgacgggccaacgtcctgactttcggggccggcagcaggctgaccgtgctgggtgagttttcgcgggaccacccgggcggcgggattcaggtggaaggcggcggtccgtctatattggcgctgatggcgcgagggaggc

SEQ ID NO: 981 - DNA, 495 bp, Artificial Sequence
  Synthetic Template Oligonucleotide for TCRB Locus
gccttgccagcccgctcagtccgtctaaggcttgacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaaggcttgagtcgacacgagcagtacttcgggccgggcaccaggctcacggtcacaggtgagattcgggcgtctccccaccttccagcccctcggtccccggagtcggagggtggtccgtctaaggcttgactgatggcgcgagggaggc

SEQ ID NO: 982 - DNA, 495 bp, Artificial Sequence
  Synthetic Template Oligonucleotide for TCRB Locus
gccttgccagcccgctcagaagagctggacactctcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggacactctgtcgacactgaagctttctttggacaaggcaccagactcacagttgtaggtaagacatttttcaggttcttttgcagatccgtcacagggaaaagtgggtccacagaagagctggacactctctgatggcgcgagggaggc

SEQ ID NO: 983 - DNA, 495 bp, Artificial Sequence
  Synthetic Template Oligonucleotide for TCRB Locus
gccttgccagcccgctcagaagagctgttcggaaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgttcggaacgtcgactatggctacaccttcggttcggggaccaggttaaccgttgtaggtaaggctgggggtctctaggaggggtgcgatgagggaggactctgtcctgggaaataagagctgttcggaacctgatggcgcgagggaggc

SEQ ID NO: 984 - DNA, 495 bp, Artificial Sequence
  Synthetic Template Oligonucleotide for TCRB Locus
gccttgccagcccgctcagaagagctgaagtaacgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgaagtaacggtcgacgaaacaccatatattttggagagggaagttggctcactgttgtaggtgagtaagtcaaggctggacagctgggaacttgcaaaaaggggctggaatccagaagagctgaagtaacgctgatggcgcgagggaggc

SEQ ID NO: 985 - DNA, 495 bp, Artificial Sequence
  Synthetic Template Oligonucleotide for TCRB Locus
gccttgccagcccgctcagaagagctggtctcctacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtctcctagtcgacaatgaaaaactgttttttggcagtggaacccagctctctgtcttgggtatgtaaaagacttctttcgggatagtgtatcataaggtcggagttccaggagaagagctggtctcctactgatggcgcgagggaggc

SEQ ID NO: 986 - DNA, 495 bp, Artificial Sequence
  Synthetic Template Oligonucleotide for TCRB Locus
gccttgccagcccgctcagaagagctgagagtgtccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgagagtgtcgtcgacatcagccccagcattttggtgatgggactcgactctccatcctaggtaagttgcagaatcagggtggtatggccattgtcccttgaaggcagagttctctaagagctgagagtgtcctgatggcgcgagggaggc

SEQ ID NO: 987 - DNA, 495 bp, Artificial Sequence
  Synthetic Template Oligonucleotide for TCRB Locus
gccttgccagcccgctcagaagagctggttccgaacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggttccgaagtcgacataattcacccctccactttgggaacgggaccaggctcactgtgacaggtatgggggctccactcttgactcgggggtgcctgggtttgactgcaatgataagagctggttccgaactgatggcgcgagggaggc

SEQ ID NO: 988 - DNA, 495 bp, Artificial Sequence
  Synthetic Template Oligonucleotide for TCRB Locus
gccttgccagcccgctcagaagagctgcgttacttcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgcgttacttgtcgacacaatgagcagttcttcgggccagggacacggctcaccgtgctaggtaagaagggggctccaggtgggagagagggtgagcagcccagcctgcacgacccaagagctgcgttacttctgatggcgcgagggaggc

SEQ ID NO: 989 - DNA, 495 bp, Artificial Sequence
  Synthetic Template Oligonucleotide for TCRB Locus
gccttgccagcccgctcagaagagctgtaggagaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgtaggagacgtcgacaccggggagctgttttttggagaaggctctaggctgaccgtactgggtaaggaggcggttggggctccggagagctccgagagggcgggatgggcagaggaagagctgtaggagacctgatggcgcgagggaggc

SEQ ID NO: 990 - DNA, 495 bp, Artificial Sequence
  Synthetic Template Oligonucleotide for TCRB Locus
gccttgccagcccgctcagaagagctggtgtctaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtgtctacgtcgacagatacgcagtattttggcccaggcacccggctgacagtgctcggtaagcgggggctcccgctgaagccccggaactggggagggggcgccccgggacgcaagagctggtgtctacctgatggcgcgagggaggc

SEQ ID NO: 991 - DNA, 495 bp, Artificial Sequence
  Synthetic Template Oligonucleotide for TCRB Locus
gccttgccagcccgctcagaagagctggtacagtgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtacagtggtcgacaaaacattcagtacttcggcgccgggacccggctctcagtgctgggtaagctggggccgccgggggaccggggacgagactgcgctcgggtttttgtgcgaagagctggtacagtgctgatggcgcgagggaggc

SEQ ID NO: 992 - DNA, 495 bp, Artificial Sequence
  Synthetic Template Oligonucleotide for TCRB Locus
gccttgccagcccgctcagaagagctgggatcatccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgggatcatcgtcgacgagacccagtacttcgggccaggcacgcggctcctggtgctcggtgagcgcgggctgctggggcgcgggcgcgggcggcttgggtctggtttttgcggggaagagctgggatcatcctgatggcgcgagggaggc

SEQ ID NO: 993 - DNA, 495 bp, Artificial Sequence
  Synthetic Template Oligonucleotide for TCRB Locus
gccttgccagcccgctcagaagagctgtattggcgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgtattggcggtcgacgggccaacgtcctgactttcggggccggcagcaggctgaccgtgctgggtgagttttcgcgggaccacccgggcggcgggattcaggtggaaggcggcggaagagctgtattggcgctgatggcgcgagggaggc

SEQ ID NO: 994 - DNA, 495 bp, Artificial Sequence
  Synthetic Template Oligonucleotide for TCRB Locus
gccttgccagcccgctcagaagagctgaggcttgacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgaggcttgagtcgacacgagcagtacttcgggccgggcaccaggctcacggtcacaggtgagattcgggcgtctccccaccttccagcccctcggtccccggagtcggagggtggaagagctgaggcttgactgatggcgcgagggaggc

SEQ ID NO: 995 - DNA, 495 bp, Artificial Sequence
  Synthetic Template Oligonucleotide for TCRB Locus
gccttgccagcccgctcagtcagatgcgacactctcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgacactctgtcgacactgaagctttctttggacaaggcaccagactcacagttgtaggtaagacatttttcaggttcttttgcagatccgtcacagggaaaagtgggtccacagtcagatgcgacactctctgatggcgcgagggaggc

SEQ ID NO: 996 - DNA, 495 bp, Artificial Sequence
  Synthetic Template Oligonucleotide for TCRB Locus
gccttgccagcccgctcagtcagatgcttcggaaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcttcggaacgtcgactatggctacaccttcggttcggggaccaggttaaccgttgtaggtaaggctgggggtctctaggaggggtgcgatgagggaggactctgtcctgggaaattcagatgcttcggaacctgatggcgcgagggaggc

SEQ ID NO: 997 - DNA, 495 bp, Artificial Sequence
  Synthetic Template Oligonucleotide for TCRB Locus
gccttgccagcccgctcagtcagatgcaagtaacgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcaagtaacggtcgacgaaacaccatatattttggagagggaagttggctcactgttgtaggtgagtaagtcaaggctggacagctgggaacttgcaaaaaggggctggaatccagtcagatgcaagtaacgctgatggcgcgagggaggc

SEQ ID NO: 998 - DNA, 495 bp, Artificial Sequence
  Synthetic Template Oligonucleotide for TCRB Locus
gccttgccagcccgctcagtcagatgcgtctcctacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtctcctagtcgacaatgaaaaactgttttttggcagtggaacccagctctctgtcttgggtatgtaaaagacttctttcgggatagtgtatcataaggtcggagttccaggagtcagatgcgtctcctactgatggcgcgagggaggc

SEQ ID NO: 999 - DNA, 495 bp, Artificial Sequence
  Synthetic Template Oligonucleotide for TCRB Locus
gccttgccagcccgctcagtcagatgcagagtgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcagagtgtcgtcgacatcagccccagcattttggtgatgggactcgactctccatcctaggtaagttgcagaatcagggtggtatggccattgtcccttgaaggcagagttctcttcagatgcagagtgtcctgatggcgcgagggaggc

SEQ ID NO: 1000 - DNA, 495 bp, Artificial Sequence
  Synthetic Template Oligonucleotide for TCRB Locus
gccttgccagcccgctcagtcagatgcgttccgaacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgttccgaagtcgacataattcacccctccactttgggaacgggaccaggctcactgtgacaggtatgggggctccactcttgactcgggggtgcctgggtttgactgcaatgattcagatgcgttccgaactgatggcgcgagggaggc

SEQ ID NO: 1001 - DNA, 495 bp, Artificial Sequence
  Synthetic Template Oligonucleotide for TCRB Locus
gccttgccagcccgctcagtcagatgccgttacttcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgccgttacttgtcgacacaatgagcagttcttcgggccagggacacggctcaccgtgctaggtaagaagggggctccaggtgggagagagggtgagcagcccagcctgcacgaccctcagatgccgttacttctgatggcgcgagggaggc

SEQ ID NO: 1002 - DNA, 495 bp, Artificial Sequence
  Synthetic Template Oligonucleotide for TCRB Locus
gccttgccagcccgctcagtcagatgctaggagaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgctaggagacgtcgacaccggggagctgttttttggagaaggctctaggctgaccgtactgggtaaggaggcggttggggctccggagagctccgagagggcgggatgggcagaggtcagatgctaggagacctgatggcgcgagggaggc

SEQ ID NO: 1003 - DNA, 495 bp, Artificial Sequence
  Synthetic Template Oligonucleotide for TCRB Locus
gccttgccagcccgctcagtcagatgcgtgtctaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtgtctacgtcgacagatacgcagtattttggcccaggcacccggctgacagtgctcggtaagcgggggctcccgctgaagccccggaactggggagggggcgccccgggacgctcagatgcgtgtctacctgatggcgcgagggaggc

SEQ ID NO: 1004 - DNA, 495 bp, Artificial Sequence
  Synthetic Template Oligonucleotide for TCRB Locus
gccttgccagcccgctcagtcagatgcgtacagtgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtacagtggtcgacaaaacattcagtacttcggcgccgggacccggctctcagtgctgggtaagctggggccgccgggggaccggggacgagactgcgctcgggtttttgtgcgtcagatgcgtacagtgctgatggcgcgagggaggc

SEQ ID NO: 1005 - DNA, 495 bp, Artificial Sequence
  Synthetic Template Oligonucleotide for TCRB Locus
gccttgccagcccgctcagtcagatgcggatcatccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcggatcatcgtcgacgagacccagtacttcgggccaggcacgcggctcctggtgctcggtgagcgcgggctgctggggcgcgggcgcgggcggcttgggtctggtttttgcggggtcagatgcggatcatcctgatggcgcgagggaggc

SEQ ID NO: 1006 - DNA, 495 bp, Artificial Sequence
  Synthetic Template Oligonucleotide for TCRB Locus
gccttgccagcccgctcagtcagatgctattggcgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgctattggcggtcgacgggccaacgtcctgactttcggggccggcagcaggctgaccgtgctgggtgagttttcgcgggaccacccgggcggcgggattcaggtggaaggcggcggtcagatgctattggcgctgatggcgcgagggaggc

SEQ ID NO: 1007 - DNA, 495 bp, Artificial Sequence
  Synthetic Template Oligonucleotide for TCRB Locus
gccttgccagcccgctcagtcagatgcaggcttgacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcaggcttgagtcgacacgagcagtacttcgggccgggcaccaggctcacggtcacaggtgagattcgggcgtctccccaccttccagcccctcggtccccggagtcggagggtggtcagatgcaggcttgactgatggcgcgagggaggc

SEQ ID NO: 1008 - DNA, 495 bp, Artificial Sequence
  Synthetic Template Oligonucleotide for TCRB Locus
gccttgccagcccgctcaggtgtagcagacactctcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagacactctgtcgacactgaagctttctttggacaaggcaccagactcacagttgtaggtaagacatttttcaggttcttttgcagatccgtcacagggaaaagtgggtccacaggtgtagcagacactctctgatggcgcgagggaggc

SEQ ID NO: 1009 - DNA, 495 bp, Artificial Sequence
  Synthetic Template Oligonucleotide for TCRB Locus
gccttgccagcccgctcaggtgtagcattcggaaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcattcggaacgtcgactatggctacaccttcggttcggggaccaggttaaccgttgtaggtaaggctgggggtctctaggaggggtgcgatgagggaggactctgtcctgggaaatgtgtagcattcggaacctgatggcgcgagggaggc

SEQ ID NO: 1010 - DNA, 495 bp, Artificial Sequence
  Synthetic Template Oligonucleotide for TCRB Locus
gccttgccagcccgctcaggtgtagcaaagtaacgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaaagtaacggtcgacgaaacaccatatattttggagagggaagttggctcactgttgtaggtgagtaagtcaaggctggacagctgggaacttgcaaaaaggggctggaatccaggtgtagcaaagtaacgctgatggcgcgagggaggc

SEQ ID NO: 1011 - DNA, 495 bp, Artificial Sequence
  Synthetic Template Oligonucleotide for TCRB Locus
gccttgccagcccgctcaggtgtagcagtctcctacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtctcctagtcgacaatgaaaaactgttttttggcagtggaacccagctctctgtcttgggtatgtaaaagacttctttcgggatagtgtatcataaggtcggagttccaggaggtgtagcagtctcctactgatggcgcgagggaggc

SEQ ID NO: 1012 - DNA, 495 bp, Artificial Sequence
  Synthetic Template Oligonucleotide for TCRB Locus
gccttgccagcccgctcaggtgtagcaagagtgtccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaagagtgtcgtcgacatcagccccagcattttggtgatgggactcgactctccatcctaggtaagttgcagaatcagggtggtatggccattgtcccttgaaggcagagttctctgtgtagcaagagtgtcctgatggcgcgagggaggc

SEQ ID NO: 1013 - DNA, 495 bp, Artificial Sequence
  Synthetic Template Oligonucleotide for TCRB Locus
gccttgccagcccgctcaggtgtagcagttccgaacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagttccgaagtcgacataattcacccctccactttgggaacgggaccaggctcactgtgacaggtatgggggctccactcttgactcgggggtgcctgggtttgactgcaatgatgtgtagcagttccgaactgatggcgcgagggaggc

SEQ ID NO: 1014 - DNA, 495 bp, Artificial Sequence
  Synthetic Template Oligonucleotide for TCRB Locus
gccttgccagcccgctcaggtgtagcacgttacttcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcacgttacttgtcgacacaatgagcagttcttcgggccagggacacggctcaccgtgctaggtaagaagggggctccaggtgggagagagggtgagcagcccagcctgcacgacccgtgtagcacgttacttctgatggcgcgagggaggc

SEQ ID NO: 1015 - DNA, 495 bp, Artificial Sequence
  Synthetic Template Oligonucleotide for TCRB Locus
gccttgccagcccgctcaggtgtagcataggagaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcataggagacgtcgacaccggggagctgttttttggagaaggctctaggctgaccgtactgggtaaggaggcggttggggctccggagagctccgagagggcgggatgggcagagggtgtagcataggagacctgatggcgcgagggaggc

SEQ ID NO: 1016 - DNA, 495 bp, Artificial Sequence
  Synthetic Template Oligonucleotide for TCRB Locus
gccttgccagcccgctcaggtgtagcagtgtctaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtgtctacgtcgacagatacgcagtattttggcccaggcacccggctgacagtgctcggtaagcgggggctcccgctgaagccccggaactggggagggggcgccccgggacgcgtgtagcagtgtctacctgatggcgcgagggaggc

SEQ ID NO: 1017 - DNA, 495 bp, Artificial Sequence
  Synthetic Template Oligonucleotide for TCRB Locus
gccttgccagcccgctcaggtgtagcagtacagtgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtacagtggtcgacaaaacattcagtacttcggcgccgggacccggctctcagtgctgggtaagctggggccgccgggggaccggggacgagactgcgctcgggtttttgtgcggtgtagcagtacagtgctgatggcgcgagggaggc

SEQ ID NO: 1018 - DNA, 495 bp, Artificial Sequence
  Synthetic Template Oligonucleotide for TCRB Locus
gccttgccagcccgctcaggtgtagcaggatcatccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaggatcatcgtcgacgagacccagtacttcgggccaggcacgcggctcctggtgctcggtgagcgcgggctgctggggcgcgggcgcgggcggcttgggtctggtttttgcgggggtgtagcaggatcatcctgatggcgcgagggaggc

SEQ ID NO: 1019 - DNA, 495 bp, Artificial Sequence
  Synthetic Template Oligonucleotide for TCRB Locus
gccttgccagcccgctcaggtgtagcatattggcgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcatattggcggtcgacgggccaacgtcctgactttcggggccggcagcaggctgaccgtgctgggtgagttttcgcgggaccacccgggcggcgggattcaggtggaaggcggcgggtgtagcatattggcgctgatggcgcgagggaggc

SEQ ID NO: 1020 - DNA, 495 bp, Artificial Sequence
  Synthetic Template Oligonucleotide for TCRB Locus
gccttgccagcccgctcaggtgtagcaaggcttgacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaaggcttgagtcgacacgagcagtacttcgggccgggcaccaggctcacggtcacaggtgagattcgggcgtctccccaccttccagcccctcggtccccggagtcggagggtgggtgtagcaaggcttgactgatggcgcgagggaggc

SEQ ID NO: 1021 - DNA, 495 bp, Artificial Sequence
  Synthetic Template Oligonucleotide for TCRB Locus
gccttgccagcccgctcagtggcagttgacactctcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgacactctgtcgacactgaagctttctttggacaaggcaccagactcacagttgtaggtaagacatttttcaggttcttttgcagatccgtcacagggaaaagtgggtccacagtggcagttgacactctctgatggcgcgagggaggc

SEQ ID NO: 1022 - DNA, 495 bp, Artificial Sequence
  Synthetic Template Oligonucleotide for TCRB Locus
gccttgccagcccgctcagtggcagttttcggaaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttttcggaacgtcgactatggctacaccttcggttcggggaccaggttaaccgttgtaggtaaggctgggggtctctaggaggggtgcgatgagggaggactctgtcctgggaaattggcagttttcggaacctgatggcgcgagggaggc

SEQ ID NO: 1023 - DNA, 495 bp, Artificial Sequence
  Synthetic Template Oligonucleotide for TCRB Locus
gccttgccagcccgctcagtggcagttaagtaacgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttaagtaacggtcgacgaaacaccatatattttggagagggaagttggctcactgttgtaggtgagtaagtcaaggctggacagctgggaacttgcaaaaaggggctggaatccagtggcagttaagtaacgctgatggcgcgagggaggc

SEQ ID NO: 1024 - DNA, 495 bp, Artificial Sequence
  Synthetic Template Oligonucleotide for TCRB Locus
gccttgccagcccgctcagtggcagttgtctcctacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtctcctagtcgacaatgaaaaactgttttttggcagtggaacccagctctctgtcttgggtatgtaaaagacttctttcgggatagtgtatcataaggtcggagttccaggagtggcagttgtctcctactgatggcgcgagggaggc

SEQ ID NO: 1025 - DNA, 495 bp, Artificial Sequence
  Synthetic Template Oligonucleotide for TCRB Locus
gccttgccagcccgctcagtggcagttagagtgtccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttagagtgtcgtcgacatcagccccagcattttggtgatgggactcgactctccatcctaggtaagttgcagaatcagggtggtatggccattgtcccttgaaggcagagttctcttggcagttagagtgtcctgatggcgcgagggaggc

SEQ ID NO: 1026 - DNA, 495 bp, Artificial Sequence
  Synthetic Template Oligonucleotide for TCRB Locus
gccttgccagcccgctcagtggcagttgttccgaacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgttccgaagtcgacataattcacccctccactttgggaacgggaccaggctcactgtgacaggtatgggggctccactcttgactcgggggtgcctgggtttgactgcaatgattggcagttgttccgaactgatggcgcgagggaggc

SEQ ID NO: 1027 - DNA, 495 bp, Artificial Sequence
  Synthetic Template Oligonucleotide for TCRB Locus
gccttgccagcccgctcagtggcagttcgttacttcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttcgttacttgtcgacacaatgagcagttcttcgggccagggacacggctcaccgtgctaggtaagaagggggctccaggtgggagagagggtgagcagcccagcctgcacgaccctggcagttcgttacttctgatggcgcgagggaggc

SEQ ID NO: 1028 - DNA, 495 bp, Artificial Sequence
  Synthetic Template Oligonucleotide for TCRB Locus
gccttgccagcccgctcagtggcagtttaggagaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagtttaggagacgtcgacaccggggagctgttttttggagaaggctctaggctgaccgtactgggtaaggaggcggttggggctccggagagctccgagagggcgggatgggcagaggtggcagtttaggagacctgatggcgcgagggaggc

SEQ ID NO: 1029 - DNA, 495 bp, Artificial Sequence
  Synthetic Template Oligonucleotide for TCRB Locus
gccttgccagcccgctcagtggcagttgtgtctaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtgtctacgtcgacagatacgcagtattttggcccaggcacccggctgacagtgctcggtaagcgggggctcccgctgaagccccggaactggggagggggcgccccgggacgctggcagttgtgtctacctgatggcgcgagggaggc

SEQ ID NO: 1030 - DNA, 495 bp, Artificial Sequence
  Synthetic Template Oligonucleotide for TCRB Locus
gccttgccagcccgctcagtggcagttgtacagtgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtacagtggtcgacaaaacattcagtacttcggcgccgggacccggctctcagtgctgggtaagctggggccgccgggggaccggggacgagactgcgctcgggtttttgtgcgtggcagttgtacagtgctgatggcgcgagggaggc

SEQ ID NO: 1031 - DNA, 495 bp, Artificial Sequence
  Synthetic Template Oligonucleotide for TCRB Locus
gccttgccagcccgctcagtggcagttggatcatccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttggatcatcgtcgacgagacccagtacttcgggccaggcacgcggctcctggtgctcggtgagcgcgggctgctggggcgcgggcgcgggcggcttgggtctggtttttgcggggtggcagttggatcatcctgatggcgcgagggaggc

SEQ ID NO: 1032 - DNA, 495 bp, Artificial Sequence
  Synthetic Template Oligonucleotide for TCRB Locus
gccttgccagcccgctcagtggcagtttattggcgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagtttattggcggtcgacgggccaacgtcctgactttcggggccggcagcaggctgaccgtgctgggtgagttttcgcgggaccacccgggcggcgggattcaggtggaaggcggcggtggcagtttattggcgctgatggcgcgagggaggc

SEQ ID NO: 1033 - DNA, 495 bp, Artificial Sequence
  Synthetic Template Oligonucleotide for TCRB Locus
gccttgccagcccgctcagtggcagttaggcttgacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttaggcttgagtcgacacgagcagtacttcgggccgggcaccaggctcacggtcacaggtgagattcgggcgtctccccaccttccagcccctcggtccccggagtcggagggtggtggcagttaggcttgactgatggcgcgagggaggc

SEQ ID NO: 1034 - DNA, 495 bp, Artificial Sequence
  Synthetic Template Oligonucleotide for TCRB Locus
gccttgccagcccgctcagcagtccaagacactctcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagacactctgtcgacactgaagctttctttggacaaggcaccagactcacagttgtaggtaagacatttttcaggttcttttgcagatccgtcacagggaaaagtgggtccacagcagtccaagacactctctgatggcgcgagggaggc

SEQ ID NO: 1035 - DNA, 495 bp, Artificial Sequence
  Synthetic Template Oligonucleotide for TCRB Locus
gccttgccagcccgctcagcagtccaattcggaaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaattcggaacgtcgactatggctacaccttcggttcggggaccaggttaaccgttgtaggtaaggctgggggtctctaggaggggtgcgatgagggaggactctgtcctgggaaatcagtccaattcggaacctgatggcgcgagggaggc

SEQ ID NO: 1036 - DNA, 495 bp, Artificial Sequence
  Synthetic Template Oligonucleotide for TCRB Locus
gccttgccagcccgctcagcagtccaaaagtaacgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaaagtaacggtcgacgaaacaccatatattttggagagggaagttggctcactgttgtaggtgagtaagtcaaggctggacagctgggaacttgcaaaaaggggctggaatccagcagtccaaaagtaacgctgatggcgcgagggaggc

SEQ ID NO: 1037 - DNA, 495 bp, Artificial Sequence
  Synthetic Template Oligonucleotide for TCRB Locus
gccttgccagcccgctcagcagtccaagtctcctacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtctcctagtcgacaatgaaaaactgttttttggcagtggaacccagctctctgtcttgggtatgtaaaagacttctttcgggatagtgtatcataaggtcggagttccaggagcagtccaagtctcctactgatggcgcgagggaggc

SEQ ID NO: 1038 - DNA, 495 bp, Artificial Sequence
  Synthetic Template Oligonucleotide for TCRB Locus
gccttgccagcccgctcagcagtccaaagagtgtccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaagagtgtcgtcgacatcagccccagcattttggtgatgggactcgactctccatcctaggtaagttgcagaatcagggtggtatggccattgtcccttgaaggcagagttctctcagtccaaagagtgtcctgatggcgcgagggaggc

SEQ ID NO: 1039 - DNA, 495 bp, Artificial Sequence
  Synthetic Template Oligonucleotide for TCRB Locus
gccttgccagcccgctcagcagtccaagttccgaacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagttccgaagtcgacataattcacccctccactttgggaacgggaccaggctcactgtgacaggtatgggggctccactcttgactcgggggtgcctgggtttgactgcaatgatcagtccaagttccgaactgatggcgcgagggaggc

SEQ ID NO: 1040 - DNA, 495 bp, Artificial Sequence
  Synthetic Template Oligonucleotide for TCRB Locus
gccttgccagcccgctcagcagtccaacgttacttcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaacgttacttgtcgacacaatgagcagttcttcgggccagggacacggctcaccgtgctaggtaagaagggggctccaggtgggagagagggtgagcagcccagcctgcacgaccccagtccaacgttacttctgatggcgcgagggaggc

SEQ ID NO: 1041 - DNA, 495 bp, Artificial Sequence
  Synthetic Template Oligonucleotide for TCRB Locus
gccttgccagcccgctcagcagtccaataggagaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaataggagacgtcgacaccggggagctgttttttggagaaggctctaggctgaccgtactgggtaaggaggcggttggggctccggagagctccgagagggcgggatgggcagaggcagtccaataggagacctgatggcgcgagggaggc

SEQ ID NO: 1042 - DNA, 495 bp, Artificial Sequence
  Synthetic Template Oligonucleotide for TCRB Locus
gccttgccagcccgctcagcagtccaagtgtctaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtgtctacgtcgacagatacgcagtattttggcccaggcacccggctgacagtgctcggtaagcgggggctcccgctgaagccccggaactggggagggggcgccccgggacgccagtccaagtgtctacctgatggcgcgagggaggc

SEQ ID NO: 1043 - DNA, 495 bp, Artificial Sequence
  Synthetic Template Oligonucleotide for TCRB Locus
gccttgccagcccgctcagcagtccaagtacagtgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtacagtggtcgacaaaacattcagtacttcggcgccgggacccggctctcagtgctgggtaagctggggccgccgggggaccggggacgagactgcgctcgggtttttgtgcgcagtccaagtacagtgctgatggcgcgagggaggc

SEQ ID NO: 1044 - DNA, 495 bp, Artificial Sequence
  Synthetic Template Oligonucleotide for TCRB Locus
gccttgccagcccgctcagcagtccaaggatcatccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaggatcatcgtcgacgagacccagtacttcgggccaggcacgcggctcctggtgctcggtgagcgcgggctgctggggcgcgggcgcgggcggcttgggtctggtttttgcggggcagtccaaggatcatcctgatggcgcgagggaggc

SEQ ID NO: 1045 - DNA, 495 bp, Artificial Sequence
  Synthetic Template Oligonucleotide for TCRB Locus
gccttgccagcccgctcagcagtccaatattggcgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaatattggcggtcgacgggccaacgtcctgactttcggggccggcagcaggctgaccgtgctgggtgagttttcgcgggaccacccgggcggcgggattcaggtggaaggcggcggcagtccaatattggcgctgatggcgcgagggaggc

SEQ ID NO: 1046 - DNA, 495 bp, Artificial Sequence
  Synthetic Template Oligonucleotide for TCRB Locus
gccttgccagcccgctcagcagtccaaaggcttgacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaaggcttgagtcgacacgagcagtacttcgggccgggcaccaggctcacggtcacaggtgagattcgggcgtctccccaccttccagcccctcggtccccggagtcggagggtggcagtccaaaggcttgactgatggcgcgagggaggc

SEQ ID NO: 1047 - DNA, 495 bp, Artificial Sequence
  Synthetic Template Oligonucleotide for TCRB Locus
gccttgccagcccgctcagtacgtacggacactctcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggacactctgtcgacactgaagctttctttggacaaggcaccagactcacagttgtaggtaagacatttttcaggttcttttgcagatccgtcacagggaaaagtgggtccacagtacgtacggacactctctgatggcgcgagggaggc

SEQ ID NO: 1048 - DNA, 495 bp, Artificial Sequence
  Synthetic Template Oligonucleotide for TCRB Locus
gccttgccagcccgctcagtacgtacgttcggaaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgttcggaacgtcgactatggctacaccttcggttcggggaccaggttaaccgttgtaggtaaggctgggggtctctaggaggggtgcgatgagggaggactctgtcctgggaaattacgtacgttcggaacctgatggcgcgagggaggc

SEQ ID NO: 1049 - DNA, 495 bp, Artificial Sequence
  Synthetic Template Oligonucleotide for TCRB Locus
gccttgccagcccgctcagtacgtacgaagtaacgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgaagtaacggtcgacgaaacaccatatattttggagagggaagttggctcactgttgtaggtgagtaagtcaaggctggacagctgggaacttgcaaaaaggggctggaatccagtacgtacgaagtaacgctgatggcgcgagggaggc

SEQ ID NO: 1050 - DNA, 495 bp, Artificial Sequence
  Synthetic Template Oligonucleotide for TCRB Locus
gccttgccagcccgctcagtacgtacggtctcctacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtctcctagtcgacaatgaaaaactgttttttggcagtggaacccagctctctgtcttgggtatgtaaaagacttctttcgggatagtgtatcataaggtcggagttccaggagtacgtacggtctcctactgatggcgcgagggaggc

SEQ ID NO: 1051 - DNA, 495 bp, Artificial Sequence
  Synthetic Template Oligonucleotide for TCRB Locus
gccttgccagcccgctcagtacgtacgagagtgtccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgagagtgtcgtcgacatcagccccagcattttggtgatgggactcgactctccatcctaggtaagttgcagaatcagggtggtatggccattgtcccttgaaggcagagttctcttacgtacgagagtgtcctgatggcgcgagggaggc

SEQ ID NO: 1052 - DNA, 495 bp, Artificial Sequence
  Synthetic Template Oligonucleotide for TCRB Locus
gccttgccagcccgctcagtacgtacggttccgaacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggttccgaagtcgacataattcacccctccactttgggaacgggaccaggctcactgtgacaggtatgggggctccactcttgactcgggggtgcctgggtttgactgcaatgattacgtacggttccgaactgatggcgcgagggaggc

SEQ ID NO: 1053 - DNA, 495 bp, Artificial Sequence
  Synthetic Template Oligonucleotide for TCRB Locus
gccttgccagcccgctcagtacgtacgcgttacttcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgcgttacttgtcgacacaatgagcagttcttcgggccagggacacggctcaccgtgctaggtaagaagggggctccaggtgggagagagggtgagcagcccagcctgcacgaccctacgtacgcgttacttctgatggcgcgagggaggc

SEQ ID NO: 1054 - DNA, 495 bp, Artificial Sequence
  Synthetic Template Oligonucleotide for TCRB Locus
gccttgccagcccgctcagtacgtacgtaggagaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgtaggagacgtcgacaccggggagctgttttttggagaaggctctaggctgaccgtactgggtaaggaggcggttggggctccggagagctccgagagggcgggatgggcagaggtacgtacgtaggagacctgatggcgcgagggaggc

SEQ ID NO: 1055 - DNA, 495 bp, Artificial Sequence
  Synthetic Template Oligonucleotide for TCRB Locus
gccttgccagcccgctcagtacgtacggtgtctaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtgtctacgtcgacagatacgcagtattttggcccaggcacccggctgacagtgctcggtaagcgggggctcccgctgaagccccggaactggggagggggcgccccgggacgctacgtacggtgtctacctgatggcgcgagggaggc

SEQ ID NO: 1056 - DNA, 495 bp, Artificial Sequence
  Synthetic Template Oligonucleotide for TCRB Locus
gccttgccagcccgctcagtacgtacggtacagtgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtacagtggtcgacaaaacattcagtacttcggcgccgggacccggctctcagtgctgggtaagctggggccgccgggggaccggggacgagactgcgctcgggtttttgtgcgtacgtacggtacagtgctgatggcgcgagggaggc

SEQ ID NO: 1057 - DNA, 495 bp, Artificial Sequence
  Synthetic Template Oligonucleotide for TCRB Locus
gccttgccagcccgctcagtacgtacgggatcatccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgggatcatcgtcgacgagacccagtacttcgggccaggcacgcggctcctggtgctcggtgagcgcgggctgctggggcgcgggcgcgggcggcttgggtctggtttttgcggggtacgtacgggatcatcctgatggcgcgagggaggc

SEQ ID NO: 1058 - DNA, 495 bp, Artificial Sequence
  Synthetic Template Oligonucleotide for TCRB Locus
gccttgccagcccgctcagtacgtacgtattggcgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgtattggcggtcgacgggccaacgtcctgactttcggggccggcagcaggctgaccgtgctgggtgagttttcgcgggaccacccgggcggcgggattcaggtggaaggcggcggtacgtacgtattggcgctgatggcgcgagggaggc

SEQ ID NO: 1059 - DNA, 495 bp, Artificial Sequence
  Synthetic Template Oligonucleotide for TCRB Locus
gccttgccagcccgctcagtacgtacgaggcttgacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgaggcttgagtcgacacgagcagtacttcgggccgggcaccaggctcacggtcacaggtgagattcgggcgtctccccaccttccagcccctcggtccccggagtcggagggtggtacgtacgaggcttgactgatggcgcgagggaggc

SEQ ID NO: 1060 - DNA, 495 bp, Artificial Sequence
  Synthetic Template Oligonucleotide for TCRB Locus
gccttgccagcccgctcagagtaccgagacactctgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagacactctgtcgacactgaagctttctttggacaaggcaccagactcacagttgtaggtaagacatttttcaggttcttttgcagatccgtcacagggaaaagtgggtccacagagtaccgagacactctctgatggcgcgagggaggc

SEQ ID NO: 1061 - DNA, 495 bp, Artificial Sequence
  Synthetic Template Oligonucleotide for TCRB Locus
gccttgccagcccgctcagagtaccgattcggaacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgattcggaacgtcgactatggctacaccttcggttcggggaccaggttaaccgttgtaggtaaggctgggggtctctaggaggggtgcgatgagggaggactctgtcctgggaaatagtaccgattcggaacctgatggcgcgagggaggc

SEQ ID NO: 1062 - DNA, 495 bp, Artificial Sequence
  Synthetic Template Oligonucleotide for TCRB Locus
gccttgccagcccgctcagagtaccgaaagtaacggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaaagtaacggtcgacgaaacaccatatattttggagagggaagttggctcactgttgtaggtgagtaagtcaaggctggacagctgggaacttgcaaaaaggggctggaatccagagtaccgaaagtaacgctgatggcgcgagggaggc

SEQ ID NO: 1063 - DNA, 495 bp, Artificial Sequence
  Synthetic Template Oligonucleotide for TCRB Locus
gccttgccagcccgctcagagtaccgagtctcctagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtctcctagtcgacaatgaaaaactgttttttggcagtggaacccagctctctgtcttgggtatgtaaaagacttctttcgggatagtgtatcataaggtcggagttccaggagagtaccgagtctcctactgatggcgcgagggaggc

SEQ ID NO: 1064 - DNA, 495 bp, Artificial Sequence
  Synthetic Template Oligonucleotide for TCRB Locus
gccttgccagcccgctcagagtaccgaagagtgtcgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaagagtgtcgtcgacatcagccccagcattttggtgatgggactcgactctccatcctaggtaagttgcagaatcagggtggtatggccattgtcccttgaaggcagagttctctagtaccgaagagtgtcctgatggcgcgagggaggc

SEQ ID NO: 1065 - DNA, 495 bp, Artificial Sequence
  Synthetic Template Oligonucleotide for TCRB Locus
gccttgccagcccgctcagagtaccgagttccgaagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagttccgaagtcgacataattcacccctccactttgggaacgggaccaggctcactgtgacaggtatgggggctccactcttgactcgggggtgcctgggtttgactgcaatgatagtaccgagttccgaactgatggcgcgagggaggc

SEQ ID NO: 1066 - DNA, 495 bp, Artificial Sequence
  Synthetic Template Oligonucleotide for TCRB Locus
gccttgccagcccgctcagagtaccgacgttacttgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgacgttacttgtcgacacaatgagcagttcttcgggccagggacacggctcaccgtgctaggtaagaagggggctccaggtgggagagagggtgagcagcccagcctgcacgacccagtaccgacgttacttctgatggcgcgagggaggc

SEQ ID NO: 1067 - DNA, 495 bp, Artificial Sequence
  Synthetic Template Oligonucleotide for TCRB Locus
gccttgccagcccgctcagagtaccgataggagacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgataggagacgtcgacaccggggagctgttttttggagaaggctctaggctgaccgtactgggtaaggaggcggttggggctccggagagctccgagagggcgggatgggcagaggagtaccgataggagacctgatggcgcgagggaggc

SEQ ID NO: 1068 - DNA, 495 bp, Artificial Sequence
  Synthetic Template Oligonucleotide for TCRB Locus
gccttgccagcccgctcagagtaccgagtgtctacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtgtctacgtcgacagatacgcagtattttggcccaggcacccggctgacagtgctcggtaagcgggggctcccgctgaagccccggaactggggagggggcgccccgggacgcagtaccgagtgtctacctgatggcgcgagggaggc

SEQ ID NO: 1069 - DNA, 495 bp, Artificial Sequence
  Synthetic Template Oligonucleotide for TCRB Locus
gccttgccagcccgctcagagtaccgagtacagtggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtacagtggtcgacaaaacattcagtacttcggcgccgggacccggctctcagtgctgggtaagctggggccgccgggggaccggggacgagactgcgctcgggtttttgtgcgagtaccgagtacagtgctgatggcgcgagggaggc

SEQ ID NO: 1070 - DNA, 495 bp, Artificial Sequence
  Synthetic Template Oligonucleotide for TCRB Locus
gccttgccagcccgctcagagtaccgaggatcatcgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaggatcatcgtcgacgagacccagtacttcgggccaggcacgcggctcctggtgctcggtgagcgcgggctgctggggcgcgggcgcgggcggcttgggtctggtttttgcggggagtaccgaggatcatcctgatggcgcgagggaggc

SEQ ID NO: 1071 - DNA, 495 bp, Artificial Sequence
  Synthetic Template Oligonucleotide for TCRB Locus
gccttgccagcccgctcagagtaccgatattggcggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgatattggcggtcgacgggccaacgtcctgactttcggggccggcagcaggctgaccgtgctgggtgagttttcgcgggaccacccgggcggcgggattcaggtggaaggcggcggagtaccgatattggcgctgatggcgcgagggaggc

SEQ ID NO: 1072 - DNA, 495 bp, Artificial Sequence
  Synthetic Template Oligonucleotide for TCRB Locus
gccttgccagcccgctcagagtaccgaaggcttgagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaaggcttgagtcgacacgagcagtacttcgggccgggcaccaggctcacggtcacaggtgagattcgggcgtctccccaccttccagcccctcggtccccggagtcggagggtggagtaccgaaggcttgactgatggcgcgagggaggc

SEQ ID NO: 1073 - DNA, 495 bp, Artificial Sequence
  Synthetic Template Oligonucleotide for TCRB Locus
gccttgccagcccgctcagatccatgggacactctcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggacactctgtcgacactgaagctttctttggacaaggcaccagactcacagttgtaggtaagacatttttcaggttcttttgcagatccgtcacagggaaaagtgggtccacagatccatgggacactctctgatggcgcgagggaggc

SEQ ID NO: 1074 - DNA, 495 bp, Artificial Sequence
  Synthetic Template Oligonucleotide for TCRB Locus
gccttgccagcccgctcagatccatggttcggaaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggttcggaacgtcgactatggctacaccttcggttcggggaccaggttaaccgttgtaggtaaggctgggggtctctaggaggggtgcgatgagggaggactctgtcctgggaaatatccatggttcggaacctgatggcgcgagggaggc

SEQ ID NO: 1075 - DNA, 495 bp, Artificial Sequence
  Synthetic Template Oligonucleotide for TCRB Locus
gccttgccagcccgctcagatccatggaagtaacgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggaagtaacggtcgacgaaacaccatatattttggagagggaagttggctcactgttgtaggtgagtaagtcaaggctggacagctgggaacttgcaaaaaggggctggaatccagatccatggaagtaacgctgatggcgcgagggaggc

SEQ ID NO: 1076 - DNA, 495 bp, Artificial Sequence
  Synthetic Template Oligonucleotide for TCRB Locus
gccttgccagcccgctcagatccatgggtctcctacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtctcctagtcgacaatgaaaaactgttttttggcagtggaacccagctctctgtcttgggtatgtaaaagacttctttcgggatagtgtatcataaggtcggagttccaggagatccatgggtctcctactgatggcgcgagggaggc

SEQ ID NO: 1077 - DNA, 495 bp, Artificial Sequence
  Synthetic Template Oligonucleotide for TCRB Locus
gccttgccagcccgctcagatccatggagagtgtccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggagagtgtcgtcgacatcagccccagcattttggtgatgggactcgactctccatcctaggtaagttgcagaatcagggtggtatggccattgtcccttgaaggcagagttctctatccatggagagtgtcctgatggcgcgagggaggc

SEQ ID NO: 1078 - DNA, 495 bp, Artificial Sequence
  Synthetic Template Oligonucleotide for TCRB Locus
gccttgccagcccgctcagatccatgggttccgaacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggttccgaagtcgacataattcacccctccactttgggaacgggaccaggctcactgtgacaggtatgggggctccactcttgactcgggggtgcctgggtttgactgcaatgatatccatgggttccgaactgatggcgcgagggaggc

SEQ ID NO: 1079 - DNA, 495 bp, Artificial Sequence
  Synthetic Template Oligonucleotide for TCRB Locus
gccttgccagcccgctcagatccatggcgttacttcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggcgttacttgtcgacacaatgagcagttcttcgggccagggacacggctcaccgtgctaggtaagaagggggctccaggtgggagagagggtgagcagcccagcctgcacgacccatccatggcgttacttctgatggcgcgagggaggc

SEQ ID NO: 1080 - DNA, 495 bp, Artificial Sequence
  Synthetic Template Oligonucleotide for TCRB Locus
gccttgccagcccgctcagatccatggtaggagaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggtaggagacgtcgacaccggggagctgttttttggagaaggctctaggctgaccgtactgggtaaggaggcggttggggctccggagagctccgagagggcgggatgggcagaggatccatggtaggagacctgatggcgcgagggaggc

SEQ ID NO: 1081 - DNA, 495 bp, Artificial Sequence
  Synthetic Template Oligonucleotide for TCRB Locus
gccttgccagcccgctcagatccatgggtgtctaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtgtctacgtcgacagatacgcagtattttggcccaggcacccggctgacagtgctcggtaagcgggggctcccgctgaagccccggaactggggagggggcgccccgggacgcatccatgggtgtctacctgatggcgcgagggaggc

SEQ ID NO: 1082 - DNA, 495 bp, Artificial Sequence
  Synthetic Template Oligonucleotide for TCRB Locus
gccttgccagcccgctcagatccatgggtacagtgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtacagtggtcgacaaaacattcagtacttcggcgccgggacccggctctcagtgctgggtaagctggggccgccgggggaccggggacgagactgcgctcgggtttttgtgcgatccatgggtacagtgctgatggcgcgagggaggc

SEQ ID NO: 1083 - DNA, 495 bp, Artificial Sequence
  Synthetic Template Oligonucleotide for TCRB Locus
gccttgccagcccgctcagatccatggggatcatccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggggatcatcgtcgacgagacccagtacttcgggccaggcacgcggctcctggtgctcggtgagcgcgggctgctggggcgcgggcgcgggcggcttgggtctggtttttgcggggatccatggggatcatcctgatggcgcgagggaggc

SEQ ID NO: 1084 - DNA, 495 bp, Artificial Sequence
  Synthetic Template Oligonucleotide for TCRB Locus
gccttgccagcccgctcagatccatggtattggcgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggtattggcggtcgacgggccaacgtcctgactttcggggccggcagcaggctgaccgtgctgggtgagttttcgcgggaccacccgggcggcgggattcaggtggaaggcggcggatccatggtattggcgctgatggcgcgagggaggc

SEQ ID NO: 1085 - DNA, 495 bp, Artificial Sequence
  Synthetic Template Oligonucleotide for TCRB Locus
gccttgccagcccgctcagatccatggaggcttgacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggaggcttgagtcgacacgagcagtacttcgggccgggcaccaggctcacggtcacaggtgagattcgggcgtctccccaccttccagcccctcggtccccggagtcggagggtggatccatggaggcttgactgatggcgcgagggaggc

SEQ ID NO: 1086 - DNA, 495 bp, Artificial Sequence
  Synthetic Template Oligonucleotide for TCRB Locus
gccttgccagcccgctcaggtagcagtgacactctctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgacactctgtcgacactgaagctttctttggacaaggcaccagactcacagttgtaggtaagacatttttcaggttcttttgcagatccgtcacagggaaaagtgggtccacaggtagcagtgacactctctgatggcgcgagggaggc

SEQ ID NO: 1087 - DNA, 495 bp, Artificial Sequence
  Synthetic Template Oligonucleotide for TCRB Locus
gccttgccagcccgctcaggtagcagtttcggaacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtttcggaacgtcgactatggctacaccttcggttcggggaccaggttaaccgttgtaggtaaggctgggggtctctaggaggggtgcgatgagggaggactctgtcctgggaaatgtagcagtttcggaacctgatggcgcgagggaggc

SEQ ID NO: 1088 - DNA, 495 bp, Artificial Sequence
  Synthetic Template Oligonucleotide for TCRB Locus
gccttgccagcccgctcaggtagcagtaagtaacgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtaagtaacggtcgacgaaacaccatatattttggagagggaagttggctcactgttgtaggtgagtaagtcaaggctggacagctgggaacttgcaaaaaggggctggaatccaggtagcagtaagtaacgctgatggcgcgagggaggc

SEQ ID NO: 1089 - DNA, 495 bp, Artificial Sequence
  Synthetic Template Oligonucleotide for TCRB Locus
gccttgccagcccgctcaggtagcagtgtctcctactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtctcctagtcgacaatgaaaaactgttttttggcagtggaacccagctctctgtcttgggtatgtaaaagacttctttcgggatagtgtatcataaggtcggagttccaggaggtagcagtgtctcctactgatggcgcgagggaggc

SEQ ID NO: 1090 - DNA, 495 bp, Artificial Sequence
  Synthetic Template Oligonucleotide for TCRB Locus
gccttgccagcccgctcaggtagcagtagagtgtcctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtagagtgtcgtcgacatcagccccagcattttggtgatgggactcgactctccatcctaggtaagttgcagaatcagggtggtatggccattgtcccttgaaggcagagttctctgtagcagtagagtgtcctgatggcgcgagggaggc

SEQ ID NO: 1091 - DNA, 495 bp, Artificial Sequence
  Synthetic Template Oligonucleotide for TCRB Locus
gccttgccagcccgctcaggtagcagtgttccgaactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgttccgaagtcgacataattcacccctccactttgggaacgggaccaggctcactgtgacaggtatgggggctccactcttgactcgggggtgcctgggtttgactgcaatgatgtagcagtgttccgaactgatggcgcgagggaggc

SEQ ID NO: 1092 - DNA, 495 bp, Artificial Sequence
  Synthetic Template Oligonucleotide for TCRB Locus
gccttgccagcccgctcaggtagcagtcgttacttctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtcgttacttgtcgacacaatgagcagttcttcgggccagggacacggctcaccgtgctaggtaagaagggggctccaggtgggagagagggtgagcagcccagcctgcacgacccgtagcagtcgttacttctgatggcgcgagggaggc

SEQ ID NO: 1093 - DNA, 495 bp, Artificial Sequence
  Synthetic Template Oligonucleotide for TCRB Locus
gccttgccagcccgctcaggtagcagttaggagacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagttaggagacgtcgacaccggggagctgttttttggagaaggctctaggctgaccgtactgggtaaggaggcggttggggctccggagagctccgagagggcgggatgggcagagggtagcagttaggagacctgatggcgcgagggaggc

SEQ ID NO: 1094 - DNA, 495 bp, Artificial Sequence
  Synthetic Template Oligonucleotide for TCRB Locus
gccttgccagcccgctcaggtagcagtgtgtctacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtgtctacgtcgacagatacgcagtattttggcccaggcacccggctgacagtgctcggtaagcgggggctcccgctgaagccccggaactggggagggggcgccccgggacgcgtagcagtgtgtctacctgatggcgcgagggaggc

SEQ ID NO: 1095 - DNA, 495 bp, Artificial Sequence
  Synthetic Template Oligonucleotide for TCRB Locus
gccttgccagcccgctcaggtagcagtgtacagtgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtacagtggtcgacaaaacattcagtacttcggcgccgggacccggctctcagtgctgggtaagctggggccgccgggggaccggggacgagactgcgctcgggtttttgtgcggtagcagtgtacagtgctgatggcgcgagggaggc

SEQ ID NO: 1096 - DNA, 495 bp, Artificial Sequence
  Synthetic Template Oligonucleotide for TCRB Locus
gccttgccagcccgctcaggtagcagtggatcatcctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtggatcatcgtcgacgagacccagtacttcgggccaggcacgcggctcctggtgctcggtgagcgcgggctgctggggcgcgggcgcgggcggcttgggtctggtttttgcgggggtagcagtggatcatcctgatggcgcgagggaggc

SEQ ID NO: 1097 - DNA, 495 bp, Artificial Sequence
  Synthetic Template Oligonucleotide for TCRB Locus
gccttgccagcccgctcaggtagcagttattggcgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagttattggcggtcgacgggccaacgtcctgactttcggggccggcagcaggctgaccgtgctgggtgagttttcgcgggaccacccgggcggcgggattcaggtggaaggcggcgggtagcagttattggcgctgatggcgcgagggaggc

SEQ ID NO: 1098 - DNA, 495 bp, Artificial Sequence
  Synthetic Template Oligonucleotide for TCRB Locus
gccttgccagcccgctcaggtagcagtaggcttgactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtaggcttgagtcgacacgagcagtacttcgggccgggcaccaggctcacggtcacaggtgagattcgggcgtctccccaccttccagcccctcggtccccggagtcggagggtgggtagcagtaggcttgactgatggcgcgagggaggc

SEQ ID NO: 1099 - DNA, 495 bp, Artificial Sequence
  Synthetic Template Oligonucleotide for TCRB Locus
gccttgccagcccgctcagatcttcgtgacactctctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgacactctgtcgacactgaagctttctttggacaaggcaccagactcacagttgtaggtaagacatttttcaggttcttttgcagatccgtcacagggaaaagtgggtccacagatcttcgtgacactctctgatggcgcgagggaggc

SEQ ID NO: 1100 - DNA, 495 bp, Artificial Sequence
  Synthetic Template Oligonucleotide for TCRB Locus
gccttgccagcccgctcagatcttcgtttcggaacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtttcggaacgtcgactatggctacaccttcggttcggggaccaggttaaccgttgtaggtaaggctgggggtctctaggaggggtgcgatgagggaggactctgtcctgggaaatatcttcgtttcggaacctgatggcgcgagggaggc

SEQ ID NO: 1101 - DNA, 495 bp, Artificial Sequence
  Synthetic Template Oligonucleotide for TCRB Locus
gccttgccagcccgctcagatcttcgtaagtaacgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtaagtaacggtcgacgaaacaccatatattttggagagggaagttggctcactgttgtaggtgagtaagtcaaggctggacagctgggaacttgcaaaaaggggctggaatccagatcttcgtaagtaacgctgatggcgcgagggaggc

SEQ ID NO: 1102 - DNA, 495 bp, Artificial Sequence
  Synthetic Template Oligonucleotide for TCRB Locus
gccttgccagcccgctcagatcttcgtgtctcctactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtctcctagtcgacaatgaaaaactgttttttggcagtggaacccagctctctgtcttgggtatgtaaaagacttctttcgggatagtgtatcataaggtcggagttccaggagatcttcgtgtctcctactgatggcgcgagggaggc

SEQ ID NO: 1103 - DNA, 495 bp, Artificial Sequence
  Synthetic Template Oligonucleotide for TCRB Locus
gccttgccagcccgctcagatcttcgtagagtgtcctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtagagtgtcgtcgacatcagccccagcattttggtgatgggactcgactctccatcctaggtaagttgcagaatcagggtggtatggccattgtcccttgaaggcagagttctctatcttcgtagagtgtcctgatggcgcgagggaggc

SEQ ID NO: 1104 - DNA, 495 bp, Artificial Sequence
  Synthetic Template Oligonucleotide for TCRB Locus
gccttgccagcccgctcagatcttcgtgttccgaactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgttccgaagtcgacataattcacccctccactttgggaacgggaccaggctcactgtgacaggtatgggggctccactcttgactcgggggtgcctgggtttgactgcaatgatatcttcgtgttccgaactgatggcgcgagggaggc

SEQ ID NO: 1105 - DNA, 495 bp, Artificial Sequence
  Synthetic Template Oligonucleotide for TCRB Locus
gccttgccagcccgctcagatcttcgtcgttacttctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtcgttacttgtcgacacaatgagcagttcttcgggccagggacacggctcaccgtgctaggtaagaagggggctccaggtgggagagagggtgagcagcccagcctgcacgacccatcttcgtcgttacttctgatggcgcgagggaggc

SEQ ID NO: 1106 - DNA, 495 bp, Artificial Sequence
  Synthetic Template Oligonucleotide for TCRB Locus
gccttgccagcccgctcagatcttcgttaggagacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgttaggagacgtcgacaccggggagctgttttttggagaaggctctaggctgaccgtactgggtaaggaggcggttggggctccggagagctccgagagggcgggatgggcagaggatcttcgttaggagacctgatggcgcgagggaggc

SEQ ID NO: 1107 - DNA, 495 bp, Artificial Sequence
  Synthetic Template Oligonucleotide for TCRB Locus
gccttgccagcccgctcagatcttcgtgtgtctacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtgtctacgtcgacagatacgcagtattttggcccaggcacccggctgacagtgctcggtaagcgggggctcccgctgaagccccggaactggggagggggcgccccgggacgcatcttcgtgtgtctacctgatggcgcgagggaggc

SEQ ID NO: 1108 - DNA, 495 bp, Artificial Sequence
  Synthetic Template Oligonucleotide for TCRB Locus
gccttgccagcccgctcagatcttcgtgtacagtgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtacagtggtcgacaaaacattcagtacttcggcgccgggacccggctctcagtgctgggtaagctggggccgccgggggaccggggacgagactgcgctcgggtttttgtgcgatcttcgtgtacagtgctgatggcgcgagggaggc

SEQ ID NO: 1109 - DNA, 495 bp, Artificial Sequence
  Synthetic Template Oligonucleotide for TCRB Locus
gccttgccagcccgctcagatcttcgtggatcatcctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtggatcatcgtcgacgagacccagtacttcgggccaggcacgcggctcctggtgctcggtgagcgcgggctgctggggcgcgggcgcgggcggcttgggtctggtttttgcggggatcttcgtggatcatcctgatggcgcgagggaggc

SEQ ID NO: 1110 - DNA, 495 bp, Artificial Sequence
  Synthetic Template Oligonucleotide for TCRB Locus
gccttgccagcccgctcagatcttcgttattggcgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgttattggcggtcgacgggccaacgtcctgactttcggggccggcagcaggctgaccgtgctgggtgagttttcgcgggaccacccgggcggcgggattcaggtggaaggcggcggatcttcgttattggcgctgatggcgcgagggaggc

SEQ ID NO: 1111 - DNA, 495 bp, Artificial Sequence
  Synthetic Template Oligonucleotide for TCRB Locus
gccttgccagcccgctcagatcttcgtaggcttgactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtaggcttgagtcgacacgagcagtacttcgggccgggcaccaggctcacggtcacaggtgagattcgggcgtctccccaccttccagcccctcggtccccggagtcggagggtggatcttcgtaggcttgactgatggcgcgagggaggc

SEQ ID NO: 1112 - DNA, 495 bp, Artificial Sequence
  Synthetic Template Oligonucleotide for TCRB Locus
gccttgccagcccgctcagtccacagtgacactctctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgacactctgtcgacactgaagctttctttggacaaggcaccagactcacagttgtaggtaagacatttttcaggttcttttgcagatccgtcacagggaaaagtgggtccacagtccacagtgacactctctgatggcgcgagggaggc

SEQ ID NO: 1113 - DNA, 495 bp, Artificial Sequence
  Synthetic Template Oligonucleotide for TCRB Locus
gccttgccagcccgctcagtccacagtttcggaacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtttcggaacgtcgactatggctacaccttcggttcggggaccaggttaaccgttgtaggtaaggctgggggtctctaggaggggtgcgatgagggaggactctgtcctgggaaattccacagtttcggaacctgatggcgcgagggaggc

SEQ ID NO: 1114 - DNA, 495 bp, Artificial Sequence
  Synthetic Template Oligonucleotide for TCRB Locus
gccttgccagcccgctcagtccacagtaagtaacgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtaagtaacggtcgacgaaacaccatatattttggagagggaagttggctcactgttgtaggtgagtaagtcaaggctggacagctgggaacttgcaaaaaggggctggaatccagtccacagtaagtaacgctgatggcgcgagggaggc

SEQ ID NO: 1115 - DNA, 495 bp, Artificial Sequence
  Synthetic Template Oligonucleotide for TCRB Locus
gccttgccagcccgctcagtccacagtgtctcctactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtctcctagtcgacaatgaaaaactgttttttggcagtggaacccagctctctgtcttgggtatgtaaaagacttctttcgggatagtgtatcataaggtcggagttccaggagtccacagtgtctcctactgatggcgcgagggaggc

SEQ ID NO: 1116 - DNA, 495 bp, Artificial Sequence
  Synthetic Template Oligonucleotide for TCRB Locus
gccttgccagcccgctcagtccacagtagagtgtcctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtagagtgtcgtcgacatcagccccagcattttggtgatgggactcgactctccatcctaggtaagttgcagaatcagggtggtatggccattgtcccttgaaggcagagttctcttccacagtagagtgtcctgatggcgcgagggaggc

SEQ ID NO: 1117 - DNA, 495 bp, Artificial Sequence
  Synthetic Template Oligonucleotide for TCRB Locus
gccttgccagcccgctcagtccacagtgttccgaactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgttccgaagtcgacataattcacccctccactttgggaacgggaccaggctcactgtgacaggtatgggggctccactcttgactcgggggtgcctgggtttgactgcaatgattccacagtgttccgaactgatggcgcgagggaggc

SEQ ID NO: 1118 - DNA, 495 bp, Artificial Sequence
  Synthetic Template Oligonucleotide for TCRB Locus
gccttgccagcccgctcagtccacagtcgttacttctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtcgttacttgtcgacacaatgagcagttcttcgggccagggacacggctcaccgtgctaggtaagaagggggctccaggtgggagagagggtgagcagcccagcctgcacgaccctccacagtcgttacttctgatggcgcgagggaggc

SEQ ID NO: 1119 - DNA, 495 bp, Artificial Sequence
  Synthetic Template Oligonucleotide for TCRB Locus
gccttgccagcccgctcagtccacagttaggagacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagttaggagacgtcgacaccggggagctgttttttggagaaggctctaggctgaccgtactgggtaaggaggcggttggggctccggagagctccgagagggcgggatgggcagaggtccacagttaggagacctgatggcgcgagggaggc

SEQ ID NO: 1120 - DNA, 495 bp, Artificial Sequence
  Synthetic Template Oligonucleotide for TCRB Locus
gccttgccagcccgctcagtccacagtgtgtctacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtgtctacgtcgacagatacgcagtattttggcccaggcacccggctgacagtgctcggtaagcgggggctcccgctgaagccccggaactggggagggggcgccccgggacgctccacagtgtgtctacctgatggcgcgagggaggc

SEQ ID NO: 1121 - DNA, 495 bp, Artificial Sequence
  Synthetic Template Oligonucleotide for TCRB Locus
gccttgccagcccgctcagtccacagtgtacagtgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtacagtggtcgacaaaacattcagtacttcggcgccgggacccggctctcagtgctgggtaagctggggccgccgggggaccggggacgagactgcgctcgggtttttgtgcgtccacagtgtacagtgctgatggcgcgagggaggc

SEQ ID NO: 1122 - DNA, 495 bp, Artificial Sequence
  Synthetic Template Oligonucleotide for TCRB Locus
gccttgccagcccgctcagtccacagtggatcatcctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtggatcatcgtcgacgagacccagtacttcgggccaggcacgcggctcctggtgctcggtgagcgcgggctgctggggcgcgggcgcgggcggcttgggtctggtttttgcggggtccacagtggatcatcctgatggcgcgagggaggc

SEQ ID NO: 1123 - DNA, 495 bp, Artificial Sequence
  Synthetic Template Oligonucleotide for TCRB Locus
gccttgccagcccgctcagtccacagttattggcgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagttattggcggtcgacgggccaacgtcctgactttcggggccggcagcaggctgaccgtgctgggtgagttttcgcgggaccacccgggcggcgggattcaggtggaaggcggcggtccacagttattggcgctgatggcgcgagggaggc

SEQ ID NO: 1124 - DNA, 495 bp, Artificial Sequence
  Synthetic Template Oligonucleotide for TCRB Locus
gccttgccagcccgctcagtccacagtaggcttgactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtaggcttgagtcgacacgagcagtacttcgggccgggcaccaggctcacggtcacaggtgagattcgggcgtctccccaccttccagcccctcggtccccggagtcggagggtggtccacagtaggcttgactgatggcgcgagggaggc

SEQ ID NO: 1125 - DNA, 495 bp, Artificial Sequence
  Synthetic Template Oligonucleotide for TCRB Locus
gccttgccagcccgctcagatgacaccgacactctttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgacactctgtcgacactgaagctttctttggacaaggcaccagactcacagttgtaggtaagacatttttcaggttcttttgcagatccgtcacagggaaaagtgggtccacagatgacaccgacactctctgatggcgcgagggaggc

SEQ ID NO: 1126 - DNA, 495 bp, Artificial Sequence
  Synthetic Template Oligonucleotide for TCRB Locus
gccttgccagcccgctcagatgacaccttcggaacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccttcggaacgtcgactatggctacaccttcggttcggggaccaggttaaccgttgtaggtaaggctgggggtctctaggaggggtgcgatgagggaggactctgtcctgggaaatatgacaccttcggaacctgatggcgcgagggaggc

SEQ ID NO: 1127 - DNA, 495 bp, Artificial Sequence
  Synthetic Template Oligonucleotide for TCRB Locus
gccttgccagcccgctcagatgacaccaagtaacgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccaagtaacggtcgacgaaacaccatatattttggagagggaagttggctcactgttgtaggtgagtaagtcaaggctggacagctgggaacttgcaaaaaggggctggaatccagatgacaccaagtaacgctgatggcgcgagggaggc

SEQ ID NO: 1128 - DNA, 495 bp, Artificial Sequence
  Synthetic Template Oligonucleotide for TCRB Locus
gccttgccagcccgctcagatgacaccgtctcctattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtctcctagtcgacaatgaaaaactgttttttggcagtggaacccagctctctgtcttgggtatgtaaaagacttctttcgggatagtgtatcataaggtcggagttccaggagatgacaccgtctcctactgatggcgcgagggaggc

SEQ ID NO: 1129 - DNA, 495 bp, Artificial Sequence
  Synthetic Template Oligonucleotide for TCRB Locus
gccttgccagcccgctcagatgacaccagagtgtcttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccagagtgtcgtcgacatcagccccagcattttggtgatgggactcgactctccatcctaggtaagttgcagaatcagggtggtatggccattgtcccttgaaggcagagttctctatgacaccagagtgtcctgatggcgcgagggaggc

SEQ ID NO: 1130 - DNA, 495 bp, Artificial Sequence
  Synthetic Template Oligonucleotide for TCRB Locus
gccttgccagcccgctcagatgacaccgttccgaattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgttccgaagtcgacataattcacccctccactttgggaacgggaccaggctcactgtgacaggtatgggggctccactcttgactcgggggtgcctgggtttgactgcaatgatatgacaccgttccgaactgatggcgcgagggaggc

SEQ ID NO: 1131 - DNA, 495 bp, Artificial Sequence
  Synthetic Template Oligonucleotide for TCRB Locus
gccttgccagcccgctcagatgacacccgttacttttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacccgttacttgtcgacacaatgagcagttcttcgggccagggacacggctcaccgtgctaggtaagaagggggctccaggtgggagagagggtgagcagcccagcctgcacgacccatgacacccgttacttctgatggcgcgagggaggc

SEQ ID NO: 1132 - DNA, 495 bp, Artificial Sequence
  Synthetic Template Oligonucleotide for TCRB Locus
gccttgccagcccgctcagatgacacctaggagacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacctaggagacgtcgacaccggggagctgttttttggagaaggctctaggctgaccgtactgggtaaggaggcggttggggctccggagagctccgagagggcgggatgggcagaggatgacacctaggagacctgatggcgcgagggaggc

SEQ ID NO: 1133 - DNA, 495 bp, Artificial Sequence
  Synthetic Template Oligonucleotide for TCRB Locus
gccttgccagcccgctcagatgacaccgtgtctacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtgtctacgtcgacagatacgcagtattttggcccaggcacccggctgacagtgctcggtaagcgggggctcccgctgaagccccggaactggggagggggcgccccgggacgcatgacaccgtgtctacctgatggcgcgagggaggc

SEQ ID NO: 1134 - DNA, 495 bp, Artificial Sequence
  Synthetic Template Oligonucleotide for TCRB Locus
gccttgccagcccgctcagatgacaccgtacagtgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtacagtggtcgacaaaacattcagtacttcggcgccgggacccggctctcagtgctgggtaagctggggccgccgggggaccggggacgagactgcgctcgggtttttgtgcgatgacaccgtacagtgctgatggcgcgagggaggc

SEQ ID NO: 1135 - DNA, 495 bp, Artificial Sequence
  Synthetic Template Oligonucleotide for TCRB Locus
gccttgccagcccgctcagatgacaccggatcatcttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccggatcatcgtcgacgagacccagtacttcgggccaggcacgcggctcctggtgctcggtgagcgcgggctgctggggcgcgggcgcgggcggcttgggtctggtttttgcggggatgacaccggatcatcctgatggcgcgagggaggc

SEQ ID NO: 1136 - DNA, 495 bp, Artificial Sequence
  Synthetic Template Oligonucleotide for TCRB Locus
gccttgccagcccgctcagatgacacctattggcgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacctattggcggtcgacgggccaacgtcctgactttcggggccggcagcaggctgaccgtgctgggtgagttttcgcgggaccacccgggcggcgggattcaggtggaaggcggcggatgacacctattggcgctgatggcgcgagggaggc

SEQ ID NO: 1137 - DNA, 495 bp, Artificial Sequence
  Synthetic Template Oligonucleotide for TCRB Locus
gccttgccagcccgctcagatgacaccaggcttgattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccaggcttgagtcgacacgagcagtacttcgggccgggcaccaggctcacggtcacaggtgagattcgggcgtctccccaccttccagcccctcggtccccggagtcggagggtggatgacaccaggcttgactgatggcgcgagggaggc

SEQ ID NO: 1138 - DNA, 495 bp, Artificial Sequence
  Synthetic Template Oligonucleotide for TCRB Locus
gccttgccagcccgctcagcttcacgagacactcttttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagacactctgtcgacactgaagctttctttggacaaggcaccagactcacagttgtaggtaagacatttttcaggttcttttgcagatccgtcacagggaaaagtgggtccacagcttcacgagacactctctgatggcgcgagggaggc

SEQ ID NO: 1139 - DNA, 495 bp, Artificial Sequence
  Synthetic Template Oligonucleotide for TCRB Locus
gccttgccagcccgctcagcttcacgattcggaactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgattcggaacgtcgactatggctacaccttcggttcggggaccaggttaaccgttgtaggtaaggctgggggtctctaggaggggtgcgatgagggaggactctgtcctgggaaatcttcacgattcggaacctgatggcgcgagggaggc

SEQ ID NO: 1140 - DNA, 495 bp, Artificial Sequence
  Synthetic Template Oligonucleotide for TCRB Locus
gccttgccagcccgctcagcttcacgaaagtaacgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaaagtaacggtcgacgaaacaccatatattttggagagggaagttggctcactgttgtaggtgagtaagtcaaggctggacagctgggaacttgcaaaaaggggctggaatccagcttcacgaaagtaacgctgatggcgcgagggaggc

SEQ ID NO: 1141 - DNA, 495 bp, Artificial Sequence
  Synthetic Template Oligonucleotide for TCRB Locus
gccttgccagcccgctcagcttcacgagtctcctatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtctcctagtcgacaatgaaaaactgttttttggcagtggaacccagctctctgtcttgggtatgtaaaagacttctttcgggatagtgtatcataaggtcggagttccaggagcttcacgagtctcctactgatggcgcgagggaggc

SEQ ID NO: 1142 - DNA, 495 bp, Artificial Sequence
  Synthetic Template Oligonucleotide for TCRB Locus
gccttgccagcccgctcagcttcacgaagagtgtctttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaagagtgtcgtcgacatcagccccagcattttggtgatgggactcgactctccatcctaggtaagttgcagaatcagggtggtatggccattgtcccttgaaggcagagttctctcttcacgaagagtgtcctgatggcgcgagggaggc

SEQ ID NO: 1143 - DNA, 495 bp, Artificial Sequence
  Synthetic Template Oligonucleotide for TCRB Locus
gccttgccagcccgctcagcttcacgagttccgaatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagttccgaagtcgacataattcacccctccactttgggaacgggaccaggctcactgtgacaggtatgggggctccactcttgactcgggggtgcctgggtttgactgcaatgatcttcacgagttccgaactgatggcgcgagggaggc

SEQ ID NO: 1144 - DNA, 495 bp, Artificial Sequence
  Synthetic Template Oligonucleotide for TCRB Locus
gccttgccagcccgctcagcttcacgacgttactttttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgacgttacttgtcgacacaatgagcagttcttcgggccagggacacggctcaccgtgctaggtaagaagggggctccaggtgggagagagggtgagcagcccagcctgcacgaccccttcacgacgttacttctgatggcgcgagggaggc

SEQ ID NO: 1145 - DNA, 495 bp, Artificial Sequence
  Synthetic Template Oligonucleotide for TCRB Locus
gccttgccagcccgctcagcttcacgataggagactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgataggagacgtcgacaccggggagctgttttttggagaaggctctaggctgaccgtactgggtaaggaggcggttggggctccggagagctccgagagggcgggatgggcagaggcttcacgataggagacctgatggcgcgagggaggc

SEQ ID NO: 1146 - DNA, 495 bp, Artificial Sequence
  Synthetic Template Oligonucleotide for TCRB Locus
gccttgccagcccgctcagcttcacgagtgtctactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtgtctacgtcgacagatacgcagtattttggcccaggcacccggctgacagtgctcggtaagcgggggctcccgctgaagccccggaactggggagggggcgccccgggacgccttcacgagtgtctacctgatggcgcgagggaggc

SEQ ID NO: 1147 - DNA, 495 bp, Artificial Sequence
  Synthetic Template Oligonucleotide for TCRB Locus
gccttgccagcccgctcagcttcacgagtacagtgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtacagtggtcgacaaaacattcagtacttcggcgccgggacccggctctcagtgctgggtaagctggggccgccgggggaccggggacgagactgcgctcgggtttttgtgcgcttcacgagtacagtgctgatggcgcgagggaggc

SEQ ID NO: 1148 - DNA, 495 bp, Artificial Sequence
  Synthetic Template Oligonucleotide for TCRB Locus
gccttgccagcccgctcagcttcacgaggatcatctttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaggatcatcgtcgacgagacccagtacttcgggccaggcacgcggctcctggtgctcggtgagcgcgggctgctggggcgcgggcgcgggcggcttgggtctggtttttgcggggcttcacgaggatcatcctgatggcgcgagggaggc

SEQ ID NO: 1149 - DNA, 495 bp, Artificial Sequence
  Synthetic Template Oligonucleotide for TCRB Locus
gccttgccagcccgctcagcttcacgatattggcgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgatattggcggtcgacgggccaacgtcctgactttcggggccggcagcaggctgaccgtgctgggtgagttttcgcgggaccacccgggcggcgggattcaggtggaaggcggcggcttcacgatattggcgctgatggcgcgagggaggc

SEQ ID NO: 1150 - DNA, 495 bp, Artificial Sequence
  Synthetic Template Oligonucleotide for TCRB Locus
gccttgccagcccgctcagcttcacgaaggcttgatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaaggcttgagtcgacacgagcagtacttcgggccgggcaccaggctcacggtcacaggtgagattcgggcgtctccccaccttccagcccctcggtccccggagtcggagggtggcttcacgaaggcttgactgatggcgcgagggaggc

SEQ ID NO: 1151 - DNA, 495 bp, Artificial Sequence
  Synthetic Template Oligonucleotide for TCRB Locus
gccttgccagcccgctcagagctagtggacactctttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggacactctgtcgacactgaagctttctttggacaaggcaccagactcacagttgtaggtaagacatttttcaggttcttttgcagatccgtcacagggaaaagtgggtccacagagctagtggacactctctgatggcgcgagggaggc

SEQ ID NO: 1152 - DNA, 495 bp, Artificial Sequence
  Synthetic Template Oligonucleotide for TCRB Locus
gccttgccagcccgctcagagctagtgttcggaacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgttcggaacgtcgactatggctacaccttcggttcggggaccaggttaaccgttgtaggtaaggctgggggtctctaggaggggtgcgatgagggaggactctgtcctgggaaatagctagtgttcggaacctgatggcgcgagggaggc

SEQ ID NO: 1153 - DNA, 495 bp, Artificial Sequence
  Synthetic Template Oligonucleotide for TCRB Locus
gccttgccagcccgctcagagctagtgaagtaacgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgaagtaacggtcgacgaaacaccatatattttggagagggaagttggctcactgttgtaggtgagtaagtcaaggctggacagctgggaacttgcaaaaaggggctggaatccagagctagtgaagtaacgctgatggcgcgagggaggc

SEQ ID NO: 1154 - DNA, 495 bp, Artificial Sequence
  Synthetic Template Oligonucleotide for TCRB Locus
gccttgccagcccgctcagagctagtggtctcctattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtctcctagtcgacaatgaaaaactgttttttggcagtggaacccagctctctgtcttgggtatgtaaaagacttctttcgggatagtgtatcataaggtcggagttccaggagagctagtggtctcctactgatggcgcgagggaggc

SEQ ID NO: 1155 - DNA, 495 bp, Artificial Sequence
  Synthetic Template Oligonucleotide for TCRB Locus
gccttgccagcccgctcagagctagtgagagtgtcttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgagagtgtcgtcgacatcagccccagcattttggtgatgggactcgactctccatcctaggtaagttgcagaatcagggtggtatggccattgtcccttgaaggcagagttctctagctagtgagagtgtcctgatggcgcgagggaggc

SEQ ID NO: 1156 - DNA, 495 bp, Artificial Sequence
  Synthetic Template Oligonucleotide for TCRB Locus
gccttgccagcccgctcagagctagtggttccgaattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggttccgaagtcgacataattcacccctccactttgggaacgggaccaggctcactgtgacaggtatgggggctccactcttgactcgggggtgcctgggtttgactgcaatgatagctagtggttccgaactgatggcgcgagggaggc

SEQ ID NO: 1157 - DNA, 495 bp, Artificial Sequence
  Synthetic Template Oligonucleotide for TCRB Locus
gccttgccagcccgctcagagctagtgcgttacttttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgcgttacttgtcgacacaatgagcagttcttcgggccagggacacggctcaccgtgctaggtaagaagggggctccaggtgggagagagggtgagcagcccagcctgcacgacccagctagtgcgttacttctgatggcgcgagggaggc

SEQ ID NO: 1158 - DNA, 495 bp, Artificial Sequence
  Synthetic Template Oligonucleotide for TCRB Locus
gccttgccagcccgctcagagctagtgtaggagacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgtaggagacgtcgacaccggggagctgttttttggagaaggctctaggctgaccgtactgggtaaggaggcggttggggctccggagagctccgagagggcgggatgggcagaggagctagtgtaggagacctgatggcgcgagggaggc

SEQ ID NO: 1159 - DNA, 495 bp, Artificial Sequence
  Synthetic Template Oligonucleotide for TCRB Locus
gccttgccagcccgctcagagctagtggtgtctacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtgtctacgtcgacagatacgcagtattttggcccaggcacccggctgacagtgctcggtaagcgggggctcccgctgaagccccggaactggggagggggcgccccgggacgcagctagtggtgtctacctgatggcgcgagggaggc

SEQ ID NO: 1160 - DNA, 495 bp, Artificial Sequence
  Synthetic Template Oligonucleotide for TCRB Locus
gccttgccagcccgctcagagctagtggtacagtgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtacagtggtcgacaaaacattcagtacttcggcgccgggacccggctctcagtgctgggtaagctggggccgccgggggaccggggacgagactgcgctcgggtttttgtgcgagctagtggtacagtgctgatggcgcgagggaggc

SEQ ID NO: 1161 - DNA, 495 bp, Artificial Sequence
  Synthetic Template Oligonucleotide for TCRB Locus
gccttgccagcccgctcagagctagtgggatcatcttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgggatcatcgtcgacgagacccagtacttcgggccaggcacgcggctcctggtgctcggtgagcgcgggctgctggggcgcgggcgcgggcggcttgggtctggtttttgcggggagctagtgggatcatcctgatggcgcgagggaggc

SEQ ID NO: 1162 - DNA, 495 bp, Artificial Sequence
  Synthetic Template Oligonucleotide for TCRB Locus
gccttgccagcccgctcagagctagtgtattggcgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgtattggcggtcgacgggccaacgtcctgactttcggggccggcagcaggctgaccgtgctgggtgagttttcgcgggaccacccgggcggcgggattcaggtggaaggcggcggagctagtgtattggcgctgatggcgcgagggaggc

SEQ ID NO: 1163 - DNA, 495 bp, Artificial Sequence
  Synthetic Template Oligonucleotide for TCRB Locus
gccttgccagcccgctcagagctagtgaggcttgattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgaggcttgagtcgacacgagcagtacttcgggccgggcaccaggctcacggtcacaggtgagattcgggcgtctccccaccttccagcccctcggtccccggagtcggagggtggagctagtgaggcttgactgatggcgcgagggaggc

SEQ ID NO: 1164 - DNA, 495 bp, Artificial Sequence
  Synthetic Template Oligonucleotide for TCRB Locus
gccttgccagcccgctcagtaaccaaggacactctttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggacactctgtcgacactgaagctttctttggacaaggcaccagactcacagttgtaggtaagacatttttcaggttcttttgcagatccgtcacagggaaaagtgggtccacagtaaccaaggacactctctgatggcgcgagggaggc

SEQ ID NO: 1165 - DNA, 495 bp, Artificial Sequence
  Synthetic Template Oligonucleotide for TCRB Locus
gccttgccagcccgctcagtaaccaagttcggaacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagttcggaacgtcgactatggctacaccttcggttcggggaccaggttaaccgttgtaggtaaggctgggggtctctaggaggggtgcgatgagggaggactctgtcctgggaaattaaccaagttcggaacctgatggcgcgagggaggc

SEQ ID NO: 1166 - DNA, 495 bp, Artificial Sequence
  Synthetic Template Oligonucleotide for TCRB Locus
gccttgccagcccgctcagtaaccaagaagtaacgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagaagtaacggtcgacgaaacaccatatattttggagagggaagttggctcactgttgtaggtgagtaagtcaaggctggacagctgggaacttgcaaaaaggggctggaatccagtaaccaagaagtaacgctgatggcgcgagggaggc

SEQ ID NO: 1167 - DNA, 495 bp, Artificial Sequence
  Synthetic Template Oligonucleotide for TCRB Locus
gccttgccagcccgctcagtaaccaaggtctcctattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtctcctagtcgacaatgaaaaactgttttttggcagtggaacccagctctctgtcttgggtatgtaaaagacttctttcgggatagtgtatcataaggtcggagttccaggagtaaccaaggtctcctactgatggcgcgagggaggc

SEQ ID NO: 1168 - DNA, 495 bp, Artificial Sequence
  Synthetic Template Oligonucleotide for TCRB Locus
gccttgccagcccgctcagtaaccaagagagtgtcttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagagagtgtcgtcgacatcagccccagcattttggtgatgggactcgactctccatcctaggtaagttgcagaatcagggtggtatggccattgtcccttgaaggcagagttctcttaaccaagagagtgtcctgatggcgcgagggaggc

SEQ ID NO: 1169 - DNA, 495 bp, Artificial Sequence
  Synthetic Template Oligonucleotide for TCRB Locus
gccttgccagcccgctcagtaaccaaggttccgaattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggttccgaagtcgacataattcacccctccactttgggaacgggaccaggctcactgtgacaggtatgggggctccactcttgactcgggggtgcctgggtttgactgcaatgattaaccaaggttccgaactgatggcgcgagggaggc

SEQ ID NO: 1170 - DNA, 495 bp, Artificial Sequence
  Synthetic Template Oligonucleotide for TCRB Locus
gccttgccagcccgctcagtaaccaagcgttacttttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagcgttacttgtcgacacaatgagcagttcttcgggccagggacacggctcaccgtgctaggtaagaagggggctccaggtgggagagagggtgagcagcccagcctgcacgaccctaaccaagcgttacttctgatggcgcgagggaggc

SEQ ID NO: 1171 - DNA, 495 bp, Artificial Sequence
  Synthetic Template Oligonucleotide for TCRB Locus
gccttgccagcccgctcagtaaccaagtaggagacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagtaggagacgtcgacaccggggagctgttttttggagaaggctctaggctgaccgtactgggtaaggaggcggttggggctccggagagctccgagagggcgggatgggcagaggtaaccaagtaggagacctgatggcgcgagggaggc

SEQ ID NO: 1172 - DNA, 495 bp, Artificial Sequence
  Synthetic Template Oligonucleotide for TCRB Locus
gccttgccagcccgctcagtaaccaaggtgtctacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtgtctacgtcgacagatacgcagtattttggcccaggcacccggctgacagtgctcggtaagcgggggctcccgctgaagccccggaactggggagggggcgccccgggacgctaaccaaggtgtctacctgatggcgcgagggaggc

SEQ ID NO: 1173 - DNA, 495 bp, Artificial Sequence
  Synthetic Template Oligonucleotide for TCRB Locus
gccttgccagcccgctcagtaaccaaggtacagtgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtacagtggtcgacaaaacattcagtacttcggcgccgggacccggctctcagtgctgggtaagctggggccgccgggggaccggggacgagactgcgctcgggtttttgtgcgtaaccaaggtacagtgctgatggcgcgagggaggc

SEQ ID NO: 1174 - DNA, 495 bp, Artificial Sequence
  Synthetic Template Oligonucleotide for TCRB Locus
gccttgccagcccgctcagtaaccaagggatcatcttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagggatcatcgtcgacgagacccagtacttcgggccaggcacgcggctcctggtgctcggtgagcgcgggctgctggggcgcgggcgcgggcggcttgggtctggtttttgcggggtaaccaagggatcatcctgatggcgcgagggaggc

SEQ ID NO: 1175 - DNA, 495 bp, Artificial Sequence
  Synthetic Template Oligonucleotide for TCRB Locus
gccttgccagcccgctcagtaaccaagtattggcgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagtattggcggtcgacgggccaacgtcctgactttcggggccggcagcaggctgaccgtgctgggtgagttttcgcgggaccacccgggcggcgggattcaggtggaaggcggcggtaaccaagtattggcgctgatggcgcgagggaggc

SEQ ID NO: 1176 - DNA, 495 bp, Artificial Sequence
  Synthetic Template Oligonucleotide for TCRB Locus
gccttgccagcccgctcagtaaccaagaggcttgattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagaggcttgagtcgacacgagcagtacttcgggccgggcaccaggctcacggtcacaggtgagattcgggcgtctccccaccttccagcccctcggtccccggagtcggagggtggtaaccaagaggcttgactgatggcgcgagggaggc

SEQ ID NO: 1177 - DNA, 495 bp, Artificial Sequence
  Synthetic Template Oligonucleotide for TCRB Locus
gccttgccagcccgctcagcaagaggtgacactctttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgacactctgtcgacactgaagctttctttggacaaggcaccagactcacagttgtaggtaagacatttttcaggttcttttgcagatccgtcacagggaaaagtgggtccacagcaagaggtgacactctctgatggcgcgagggaggc

SEQ ID NO: 1178 - DNA, 495 bp, Artificial Sequence
  Synthetic Template Oligonucleotide for TCRB Locus
gccttgccagcccgctcagcaagaggtttcggaacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtttcggaacgtcgactatggctacaccttcggttcggggaccaggttaaccgttgtaggtaaggctgggggtctctaggaggggtgcgatgagggaggactctgtcctgggaaatcaagaggtttcggaacctgatggcgcgagggaggc

SEQ ID NO: 1179 - DNA, 495 bp, Artificial Sequence
  Synthetic Template Oligonucleotide for TCRB Locus
gccttgccagcccgctcagcaagaggtaagtaacgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtaagtaacggtcgacgaaacaccatatattttggagagggaagttggctcactgttgtaggtgagtaagtcaaggctggacagctgggaacttgcaaaaaggggctggaatccagcaagaggtaagtaacgctgatggcgcgagggaggc

SEQ ID NO: 1180 - DNA, 495 bp, Artificial Sequence
  Synthetic Template Oligonucleotide for TCRB Locus
gccttgccagcccgctcagcaagaggtgtctcctattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtctcctagtcgacaatgaaaaactgttttttggcagtggaacccagctctctgtcttgggtatgtaaaagacttctttcgggatagtgtatcataaggtcggagttccaggagcaagaggtgtctcctactgatggcgcgagggaggc

SEQ ID NO: 1181 - DNA, 495 bp, Artificial Sequence
  Synthetic Template Oligonucleotide for TCRB Locus
gccttgccagcccgctcagcaagaggtagagtgtcttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtagagtgtcgtcgacatcagccccagcattttggtgatgggactcgactctccatcctaggtaagttgcagaatcagggtggtatggccattgtcccttgaaggcagagttctctcaagaggtagagtgtcctgatggcgcgagggaggc

SEQ ID NO: 1182 - DNA, 495 bp, Artificial Sequence
  Synthetic Template Oligonucleotide for TCRB Locus
gccttgccagcccgctcagcaagaggtgttccgaattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgttccgaagtcgacataattcacccctccactttgggaacgggaccaggctcactgtgacaggtatgggggctccactcttgactcgggggtgcctgggtttgactgcaatgatcaagaggtgttccgaactgatggcgcgagggaggc

SEQ ID NO: 1183 - DNA, 495 bp, Artificial Sequence
  Synthetic Template Oligonucleotide for TCRB Locus
gccttgccagcccgctcagcaagaggtcgttacttttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtcgttacttgtcgacacaatgagcagttcttcgggccagggacacggctcaccgtgctaggtaagaagggggctccaggtgggagagagggtgagcagcccagcctgcacgaccccaagaggtcgttacttctgatggcgcgagggaggc

SEQ ID NO: 1184 - DNA, 495 bp, Artificial Sequence
  Synthetic Template Oligonucleotide for TCRB Locus
gccttgccagcccgctcagcaagaggttaggagacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggttaggagacgtcgacaccggggagctgttttttggagaaggctctaggctgaccgtactgggtaaggaggcggttggggctccggagagctccgagagggcgggatgggcagaggcaagaggttaggagacctgatggcgcgagggaggc

SEQ ID NO: 1185 - DNA, 495 bp, Artificial Sequence
  Synthetic Template Oligonucleotide for TCRB Locus
gccttgccagcccgctcagcaagaggtgtgtctacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtgtctacgtcgacagatacgcagtattttggcccaggcacccggctgacagtgctcggtaagcgggggctcccgctgaagccccggaactggggagggggcgccccgggacgccaagaggtgtgtctacctgatggcgcgagggaggc

SEQ ID NO: 1186 - DNA, 495 bp, Artificial Sequence
  Synthetic Template Oligonucleotide for TCRB Locus
gccttgccagcccgctcagcaagaggtgtacagtgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtacagtggtcgacaaaacattcagtacttcggcgccgggacccggctctcagtgctgggtaagctggggccgccgggggaccggggacgagactgcgctcgggtttttgtgcgcaagaggtgtacagtgctgatggcgcgagggaggc

SEQ ID NO: 1187 - DNA, 495 bp, Artificial Sequence
  Synthetic Template Oligonucleotide for TCRB Locus
gccttgccagcccgctcagcaagaggtggatcatcttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtggatcatcgtcgacgagacccagtacttcgggccaggcacgcggctcctggtgctcggtgagcgcgggctgctggggcgcgggcgcgggcggcttgggtctggtttttgcggggcaagaggtggatcatcctgatggcgcgagggaggc

SEQ ID NO: 1188 - DNA, 495 bp, Artificial Sequence
  Synthetic Template Oligonucleotide for TCRB Locus
gccttgccagcccgctcagcaagaggttattggcgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggttattggcggtcgacgggccaacgtcctgactttcggggccggcagcaggctgaccgtgctgggtgagttttcgcgggaccacccgggcggcgggattcaggtggaaggcggcggcaagaggttattggcgctgatggcgcgagggaggc

SEQ ID NO: 1189 - DNA, 495 bp, Artificial Sequence
  Synthetic Template Oligonucleotide for TCRB Locus
gccttgccagcccgctcagcaagaggtaggcttgattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtaggcttgagtcgacacgagcagtacttcgggccgggcaccaggctcacggtcacaggtgagattcgggcgtctccccaccttccagcccctcggtccccggagtcggagggtggcaagaggtaggcttgactgatggcgcgagggaggc

SEQ ID NO: 1190 - DNA, 495 bp, Artificial Sequence
  Synthetic Template Oligonucleotide for TCRB Locus
gccttgccagcccgctcagagaatcaggacactctctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggacactctgtcgacactgaagctttctttggacaaggcaccagactcacagttgtaggtaagacatttttcaggttcttttgcagatccgtcacagggaaaagtgggtccacagagaatcaggacactctctgatggcgcgagggaggc

SEQ ID NO: 1191 - DNA, 495 bp, Artificial Sequence
  Synthetic Template Oligonucleotide for TCRB Locus
gccttgccagcccgctcagagaatcagttcggaacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagttcggaacgtcgactatggctacaccttcggttcggggaccaggttaaccgttgtaggtaaggctgggggtctctaggaggggtgcgatgagggaggactctgtcctgggaaatagaatcagttcggaacctgatggcgcgagggaggc

SEQ ID NO: 1192 - DNA, 495 bp, Artificial Sequence
  Synthetic Template Oligonucleotide for TCRB Locus
gccttgccagcccgctcagagaatcagaagtaacgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagaagtaacggtcgacgaaacaccatatattttggagagggaagttggctcactgttgtaggtgagtaagtcaaggctggacagctgggaacttgcaaaaaggggctggaatccagagaatcagaagtaacgctgatggcgcgagggaggc

SEQ ID NO: 1193 - DNA, 495 bp, Artificial Sequence
  Synthetic Template Oligonucleotide for TCRB Locus
gccttgccagcccgctcagagaatcaggtctcctactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtctcctagtcgacaatgaaaaactgttttttggcagtggaacccagctctctgtcttgggtatgtaaaagacttctttcgggatagtgtatcataaggtcggagttccaggagagaatcaggtctcctactgatggcgcgagggaggc

SEQ ID NO: 1194 - DNA, 495 bp, Artificial Sequence
  Synthetic Template Oligonucleotide for TCRB Locus
gccttgccagcccgctcagagaatcagagagtgtcctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagagagtgtcgtcgacatcagccccagcattttggtgatgggactcgactctccatcctaggtaagttgcagaatcagggtggtatggccattgtcccttgaaggcagagttctctagaatcagagagtgtcctgatggcgcgagggaggc

SEQ ID NO: 1195 - DNA, 495 bp, Artificial Sequence
  Synthetic Template Oligonucleotide for TCRB Locus
gccttgccagcccgctcagagaatcaggttccgaactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggttccgaagtcgacataattcacccctccactttgggaacgggaccaggctcactgtgacaggtatgggggctccactcttgactcgggggtgcctgggtttgactgcaatgatagaatcaggttccgaactgatggcgcgagggaggc

SEQ ID NO: 1196 - DNA, 495 bp, Artificial Sequence
  Synthetic Template Oligonucleotide for TCRB Locus
gccttgccagcccgctcagagaatcagcgttacttctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagcgttacttgtcgacacaatgagcagttcttcgggccagggacacggctcaccgtgctaggtaagaagggggctccaggtgggagagagggtgagcagcccagcctgcacgacccagaatcagcgttacttctgatggcgcgagggaggc

SEQ ID NO: 1197 - DNA, 495 bp, Artificial Sequence
  Synthetic Template Oligonucleotide for TCRB Locus
gccttgccagcccgctcagagaatcagtaggagacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagtaggagacgtcgacaccggggagctgttttttggagaaggctctaggctgaccgtactgggtaaggaggcggttggggctccggagagctccgagagggcgggatgggcagaggagaatcagtaggagacctgatggcgcgagggaggc

SEQ ID NO: 1198 - DNA, 495 bp, Artificial Sequence
  Synthetic Template Oligonucleotide for TCRB Locus
gccttgccagcccgctcagagaatcaggtgtctacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtgtctacgtcgacagatacgcagtattttggcccaggcacccggctgacagtgctcggtaagcgggggctcccgctgaagccccggaactggggagggggcgccccgggacgcagaatcaggtgtctacctgatggcgcgagggaggc

SEQ ID NO: 1199 - DNA, 495 bp, Artificial Sequence
  Synthetic Template Oligonucleotide for TCRB Locus
gccttgccagcccgctcagagaatcaggtacagtgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtacagtggtcgacaaaacattcagtacttcggcgccgggacccggctctcagtgctgggtaagctggggccgccgggggaccggggacgagactgcgctcgggtttttgtgcgagaatcaggtacagtgctgatggcgcgagggaggc

SEQ ID NO: 1200 - DNA, 495 bp, Artificial Sequence
  Synthetic Template Oligonucleotide for TCRB Locus
gccttgccagcccgctcagagaatcagggatcatcctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagggatcatcgtcgacgagacccagtacttcgggccaggcacgcggctcctggtgctcggtgagcgcgggctgctggggcgcgggcgcgggcggcttgggtctggtttttgcggggagaatcagggatcatcctgatggcgcgagggaggc

SEQ ID NO: 1201 - DNA, 495 bp, Artificial Sequence
  Synthetic Template Oligonucleotide for TCRB Locus
gccttgccagcccgctcagagaatcagtattggcgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagtattggcggtcgacgggccaacgtcctgactttcggggccggcagcaggctgaccgtgctgggtgagttttcgcgggaccacccgggcggcgggattcaggtggaaggcggcggagaatcagtattggcgctgatggcgcgagggaggc

SEQ ID NO: 1202 - DNA, 495 bp, Artificial Sequence
  Synthetic Template Oligonucleotide for TCRB Locus
gccttgccagcccgctcagagaatcagaggcttgactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagaggcttgagtcgacacgagcagtacttcgggccgggcaccaggctcacggtcacaggtgagattcgggcgtctccccaccttccagcccctcggtccccggagtcggagggtggagaatcagaggcttgactgatggcgcgagggaggc

SEQ ID NO: 1203 - DNA, 495 bp, Artificial Sequence
  Synthetic Template Oligonucleotide for TCRB Locus
gccttgccagcccgctcagagttgaccgacactctctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgacactctgtcgacactgaagctttctttggacaaggcaccagactcacagttgtaggtaagacatttttcaggttcttttgcagatccgtcacagggaaaagtgggtccacagagttgaccgacactctctgatggcgcgagggaggc

SEQ ID NO: 1204 - DNA, 495 bp, Artificial Sequence
  Synthetic Template Oligonucleotide for TCRB Locus
gccttgccagcccgctcagagttgaccttcggaacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccttcggaacgtcgactatggctacaccttcggttcggggaccaggttaaccgttgtaggtaaggctgggggtctctaggaggggtgcgatgagggaggactctgtcctgggaaatagttgaccttcggaacctgatggcgcgagggaggc

SEQ ID NO: 1205 - DNA, 495 bp, Artificial Sequence
  Synthetic Template Oligonucleotide for TCRB Locus
gccttgccagcccgctcagagttgaccaagtaacgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccaagtaacggtcgacgaaacaccatatattttggagagggaagttggctcactgttgtaggtgagtaagtcaaggctggacagctgggaacttgcaaaaaggggctggaatccagagttgaccaagtaacgctgatggcgcgagggaggc

SEQ ID NO: 1206 - DNA, 495 bp, Artificial Sequence
  Synthetic Template Oligonucleotide for TCRB Locus
gccttgccagcccgctcagagttgaccgtctcctactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtctcctagtcgacaatgaaaaactgttttttggcagtggaacccagctctctgtcttgggtatgtaaaagacttctttcgggatagtgtatcataaggtcggagttccaggagagttgaccgtctcctactgatggcgcgagggaggc

SEQ ID NO: 1207 - DNA, 495 bp, Artificial Sequence
  Synthetic Template Oligonucleotide for TCRB Locus
gccttgccagcccgctcagagttgaccagagtgtcctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccagagtgtcgtcgacatcagccccagcattttggtgatgggactcgactctccatcctaggtaagttgcagaatcagggtggtatggccattgtcccttgaaggcagagttctctagttgaccagagtgtcctgatggcgcgagggaggc

SEQ ID NO: 1208 - DNA, 495 bp, Artificial Sequence
  Synthetic Template Oligonucleotide for TCRB Locus
gccttgccagcccgctcagagttgaccgttccgaactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgttccgaagtcgacataattcacccctccactttgggaacgggaccaggctcactgtgacaggtatgggggctccactcttgactcgggggtgcctgggtttgactgcaatgatagttgaccgttccgaactgatggcgcgagggaggc

SEQ ID NO: 1209 - DNA, 495 bp, Artificial Sequence
  Synthetic Template Oligonucleotide for TCRB Locus
gccttgccagcccgctcagagttgacccgttacttctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacccgttacttgtcgacacaatgagcagttcttcgggccagggacacggctcaccgtgctaggtaagaagggggctccaggtgggagagagggtgagcagcccagcctgcacgacccagttgacccgttacttctgatggcgcgagggaggc

SEQ ID NO: 1210 - DNA, 495 bp, Artificial Sequence
  Synthetic Template Oligonucleotide for TCRB Locus
gccttgccagcccgctcagagttgacctaggagacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacctaggagacgtcgacaccggggagctgttttttggagaaggctctaggctgaccgtactgggtaaggaggcggttggggctccggagagctccgagagggcgggatgggcagaggagttgacctaggagacctgatggcgcgagggaggc

SEQ ID NO: 1211 - DNA, 495 bp, Artificial Sequence
  Synthetic Template Oligonucleotide for TCRB Locus
gccttgccagcccgctcagagttgaccgtgtctacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtgtctacgtcgacagatacgcagtattttggcccaggcacccggctgacagtgctcggtaagcgggggctcccgctgaagccccggaactggggagggggcgccccgggacgcagttgaccgtgtctacctgatggcgcgagggaggc

SEQ ID NO: 1212 - DNA, 495 bp, Artificial Sequence
  Synthetic Template Oligonucleotide for TCRB Locus
gccttgccagcccgctcagagttgaccgtacagtgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtacagtggtcgacaaaacattcagtacttcggcgccgggacccggctctcagtgctgggtaagctggggccgccgggggaccggggacgagactgcgctcgggtttttgtgcgagttgaccgtacagtgctgatggcgcgagggaggc

SEQ ID NO: 1213 - DNA, 495 bp, Artificial Sequence
  Synthetic Template Oligonucleotide for TCRB Locus
gccttgccagcccgctcagagttgaccggatcatcctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccggatcatcgtcgacgagacccagtacttcgggccaggcacgcggctcctggtgctcggtgagcgcgggctgctggggcgcgggcgcgggcggcttgggtctggtttttgcggggagttgaccggatcatcctgatggcgcgagggaggc

SEQ ID NO: 1214 - DNA, 495 bp, Artificial Sequence
  Synthetic Template Oligonucleotide for TCRB Locus
gccttgccagcccgctcagagttgacctattggcgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacctattggcggtcgacgggccaacgtcctgactttcggggccggcagcaggctgaccgtgctgggtgagttttcgcgggaccacccgggcggcgggattcaggtggaaggcggcggagttgacctattggcgctgatggcgcgagggaggc

SEQ ID NO: 1215 - DNA, 495 bp, Artificial Sequence
  Synthetic Template Oligonucleotide for TCRB Locus
gccttgccagcccgctcagagttgaccaggcttgactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccaggcttgagtcgacacgagcagtacttcgggccgggcaccaggctcacggtcacaggtgagattcgggcgtctccccaccttccagcccctcggtccccggagtcggagggtggagttgaccaggcttgactgatggcgcgagggaggc

SEQ ID NO: 1216 - DNA, 495 bp, Artificial Sequence
  Synthetic Template Oligonucleotide for TCRB Locus
gccttgccagcccgctcagcgtacgtagacactctttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagacactctgtcgacactgaagctttctttggacaaggcaccagactcacagttgtaggtaagacatttttcaggttcttttgcagatccgtcacagggaaaagtgggtccacagcgtacgtagacactctctgatggcgcgagggaggc

SEQ ID NO: 1217 - DNA, 495 bp, Artificial Sequence
  Synthetic Template Oligonucleotide for TCRB Locus
gccttgccagcccgctcagcgtacgtattcggaacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtattcggaacgtcgactatggctacaccttcggttcggggaccaggttaaccgttgtaggtaaggctgggggtctctaggaggggtgcgatgagggaggactctgtcctgggaaatcgtacgtattcggaacctgatggcgcgagggaggc

SEQ ID NO: 1218 - DNA, 495 bp, Artificial Sequence
  Synthetic Template Oligonucleotide for TCRB Locus
gccttgccagcccgctcagcgtacgtaaagtaacgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaaagtaacggtcgacgaaacaccatatattttggagagggaagttggctcactgttgtaggtgagtaagtcaaggctggacagctgggaacttgcaaaaaggggctggaatccagcgtacgtaaagtaacgctgatggcgcgagggaggc

SEQ ID NO: 1219 - DNA, 495 bp, Artificial Sequence
  Synthetic Template Oligonucleotide for TCRB Locus
gccttgccagcccgctcagcgtacgtagtctcctattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtctcctagtcgacaatgaaaaactgttttttggcagtggaacccagctctctgtcttgggtatgtaaaagacttctttcgggatagtgtatcataaggtcggagttccaggagcgtacgtagtctcctactgatggcgcgagggaggc

SEQ ID NO: 1220 - DNA, 495 bp, Artificial Sequence
  Synthetic Template Oligonucleotide for TCRB Locus
gccttgccagcccgctcagcgtacgtaagagtgtcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaagagtgtcgtcgacatcagccccagcattttggtgatgggactcgactctccatcctaggtaagttgcagaatcagggtggtatggccattgtcccttgaaggcagagttctctcgtacgtaagagtgtcctgatggcgcgagggaggc

SEQ ID NO: 1221 - DNA, 495 bp, Artificial Sequence
  Synthetic Template Oligonucleotide for TCRB Locus
gccttgccagcccgctcagcgtacgtagttccgaattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagttccgaagtcgacataattcacccctccactttgggaacgggaccaggctcactgtgacaggtatgggggctccactcttgactcgggggtgcctgggtttgactgcaatgatcgtacgtagttccgaactgatggcgcgagggaggc

SEQ ID NO: 1222 - DNA, 495 bp, Artificial Sequence
  Synthetic Template Oligonucleotide for TCRB Locus
gccttgccagcccgctcagcgtacgtacgttacttttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtacgttacttgtcgacacaatgagcagttcttcgggccagggacacggctcaccgtgctaggtaagaagggggctccaggtgggagagagggtgagcagcccagcctgcacgaccccgtacgtacgttacttctgatggcgcgagggaggc

SEQ ID NO: 1223 - DNA, 495 bp, Artificial Sequence
  Synthetic Template Oligonucleotide for TCRB Locus
gccttgccagcccgctcagcgtacgtataggagacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtataggagacgtcgacaccggggagctgttttttggagaaggctctaggctgaccgtactgggtaaggaggcggttggggctccggagagctccgagagggcgggatgggcagaggcgtacgtataggagacctgatggcgcgagggaggc

SEQ ID NO: 1224 - DNA, 495 bp, Artificial Sequence
  Synthetic Template Oligonucleotide for TCRB Locus
gccttgccagcccgctcagcgtacgtagtgtctacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtgtctacgtcgacagatacgcagtattttggcccaggcacccggctgacagtgctcggtaagcgggggctcccgctgaagccccggaactggggagggggcgccccgggacgccgtacgtagtgtctacctgatggcgcgagggaggc

SEQ ID NO: 1225 - DNA, 495 bp, Artificial Sequence
  Synthetic Template Oligonucleotide for TCRB Locus
gccttgccagcccgctcagcgtacgtagtacagtgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtacagtggtcgacaaaacattcagtacttcggcgccgggacccggctctcagtgctgggtaagctggggccgccgggggaccggggacgagactgcgctcgggtttttgtgcgcgtacgtagtacagtgctgatggcgcgagggaggc

SEQ ID NO: 1226 - DNA, 495 bp, Artificial Sequence
  Synthetic Template Oligonucleotide for TCRB Locus
gccttgccagcccgctcagcgtacgtaggatcatcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaggatcatcgtcgacgagacccagtacttcgggccaggcacgcggctcctggtgctcggtgagcgcgggctgctggggcgcgggcgcgggcggcttgggtctggtttttgcggggcgtacgtaggatcatcctgatggcgcgagggaggc

SEQ ID NO: 1227 - DNA, 495 bp, Artificial Sequence
  Synthetic Template Oligonucleotide for TCRB Locus
gccttgccagcccgctcagcgtacgtatattggcgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtatattggcggtcgacgggccaacgtcctgactttcggggccggcagcaggctgaccgtgctgggtgagttttcgcgggaccacccgggcggcgggattcaggtggaaggcggcggcgtacgtatattggcgctgatggcgcgagggaggc

SEQ ID NO: 1228 - DNA, 495 bp, Artificial Sequence
  Synthetic Template Oligonucleotide for TCRB Locus
gccttgccagcccgctcagcgtacgtaaggcttgattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaaggcttgagtcgacacgagcagtacttcgggccgggcaccaggctcacggtcacaggtgagattcgggcgtctccccaccttccagcccctcggtccccggagtcggagggtggcgtacgtaaggcttgactgatggcgcgagggaggc

SEQ ID NO: 1229 - DNA, 495 bp, Artificial Sequence
  Synthetic Template Oligonucleotide for TCRB Locus
gccttgccagcccgctcagtcggtactgacactcttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgacactctgtcgacactgaagctttctttggacaaggcaccagactcacagttgtaggtaagacatttttcaggttcttttgcagatccgtcacagggaaaagtgggtccacagtcggtactgacactctctgatggcgcgagggaggc

SEQ ID NO: 1230 - DNA, 495 bp, Artificial Sequence
  Synthetic Template Oligonucleotide for TCRB Locus
gccttgccagcccgctcagtcggtactttcggaactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactttcggaacgtcgactatggctacaccttcggttcggggaccaggttaaccgttgtaggtaaggctgggggtctctaggaggggtgcgatgagggaggactctgtcctgggaaattcggtactttcggaacctgatggcgcgagggaggc

SEQ ID NO: 1231 - DNA, 495 bp, Artificial Sequence
  Synthetic Template Oligonucleotide for TCRB Locus
gccttgccagcccgctcagtcggtactaagtaacgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactaagtaacggtcgacgaaacaccatatattttggagagggaagttggctcactgttgtaggtgagtaagtcaaggctggacagctgggaacttgcaaaaaggggctggaatccagtcggtactaagtaacgctgatggcgcgagggaggc

SEQ ID NO: 1232 - DNA, 495 bp, Artificial Sequence
  Synthetic Template Oligonucleotide for TCRB Locus
gccttgccagcccgctcagtcggtactgtctcctatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtctcctagtcgacaatgaaaaactgttttttggcagtggaacccagctctctgtcttgggtatgtaaaagacttctttcgggatagtgtatcataaggtcggagttccaggagtcggtactgtctcctactgatggcgcgagggaggc

SEQ ID NO: 1233 - DNA, 495 bp, Artificial Sequence
  Synthetic Template Oligonucleotide for TCRB Locus
gccttgccagcccgctcagtcggtactagagtgtctctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactagagtgtcgtcgacatcagccccagcattttggtgatgggactcgactctccatcctaggtaagttgcagaatcagggtggtatggccattgtcccttgaaggcagagttctcttcggtactagagtgtcctgatggcgcgagggaggc

SEQ ID NO: 1234 - DNA, 495 bp, Artificial Sequence
  Synthetic Template Oligonucleotide for TCRB Locus
gccttgccagcccgctcagtcggtactgttccgaatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgttccgaagtcgacataattcacccctccactttgggaacgggaccaggctcactgtgacaggtatgggggctccactcttgactcgggggtgcctgggtttgactgcaatgattcggtactgttccgaactgatggcgcgagggaggc

SEQ ID NO: 1235 - DNA, 495 bp, Artificial Sequence
  Synthetic Template Oligonucleotide for TCRB Locus
gccttgccagcccgctcagtcggtactcgttactttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactcgttacttgtcgacacaatgagcagttcttcgggccagggacacggctcaccgtgctaggtaagaagggggctccaggtgggagagagggtgagcagcccagcctgcacgaccctcggtactcgttacttctgatggcgcgagggaggc

SEQ ID NO: 1236 - DNA, 495 bp, Artificial Sequence
  Synthetic Template Oligonucleotide for TCRB Locus
gccttgccagcccgctcagtcggtacttaggagactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtacttaggagacgtcgacaccggggagctgttttttggagaaggctctaggctgaccgtactgggtaaggaggcggttggggctccggagagctccgagagggcgggatgggcagaggtcggtacttaggagacctgatggcgcgagggaggc

SEQ ID NO: 1237 - DNA, 495 bp, Artificial Sequence
  Synthetic Template Oligonucleotide for TCRB Locus
gccttgccagcccgctcagtcggtactgtgtctactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtgtctacgtcgacagatacgcagtattttggcccaggcacccggctgacagtgctcggtaagcgggggctcccgctgaagccccggaactggggagggggcgccccgggacgctcggtactgtgtctacctgatggcgcgagggaggc

SEQ ID NO: 1238 - DNA, 495 bp, Artificial Sequence
  Synthetic Template Oligonucleotide for TCRB Locus
gccttgccagcccgctcagtcggtactgtacagtgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtacagtggtcgacaaaacattcagtacttcggcgccgggacccggctctcagtgctgggtaagctggggccgccgggggaccggggacgagactgcgctcgggtttttgtgcgtcggtactgtacagtgctgatggcgcgagggaggc

SEQ ID NO: 1239 - DNA, 495 bp, Artificial Sequence
  Synthetic Template Oligonucleotide for TCRB Locus
gccttgccagcccgctcagtcggtactggatcatctctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactggatcatcgtcgacgagacccagtacttcgggccaggcacgcggctcctggtgctcggtgagcgcgggctgctggggcgcgggcgcgggcggcttgggtctggtttttgcggggtcggtactggatcatcctgatggcgcgagggaggc

SEQ ID NO: 1240 - DNA, 495 bp, Artificial Sequence
  Synthetic Template Oligonucleotide for TCRB Locus
gccttgccagcccgctcagtcggtacttattggcgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtacttattggcggtcgacgggccaacgtcctgactttcggggccggcagcaggctgaccgtgctgggtgagttttcgcgggaccacccgggcggcgggattcaggtggaaggcggcggtcggtacttattggcgctgatggcgcgagggaggc

SEQ ID NO: 1241 - DNA, 495 bp, Artificial Sequence
  Synthetic Template Oligonucleotide for TCRB Locus
gccttgccagcccgctcagtcggtactaggcttgatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactaggcttgagtcgacacgagcagtacttcgggccgggcaccaggctcacggtcacaggtgagattcgggcgtctccccaccttccagcccctcggtccccggagtcggagggtggtcggtactaggcttgactgatggcgcgagggaggc

SEQ ID NO: 1242 - DNA, 495 bp, Artificial Sequence
  Synthetic Template Oligonucleotide for TCRB Locus
gccttgccagcccgctcagccatggatgacactctctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgacactctgtcgacactgaagctttctttggacaaggcaccagactcacagttgtaggtaagacatttttcaggttcttttgcagatccgtcacagggaaaagtgggtccacagccatggatgacactctctgatggcgcgagggaggc

SEQ ID NO: 1243 - DNA, 495 bp, Artificial Sequence
  Synthetic Template Oligonucleotide for TCRB Locus
gccttgccagcccgctcagccatggatttcggaacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatttcggaacgtcgactatggctacaccttcggttcggggaccaggttaaccgttgtaggtaaggctgggggtctctaggaggggtgcgatgagggaggactctgtcctgggaaatccatggatttcggaacctgatggcgcgagggaggc

SEQ ID NO: 1244 - DNA, 495 bp, Artificial Sequence
  Synthetic Template Oligonucleotide for TCRB Locus
gccttgccagcccgctcagccatggataagtaacgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggataagtaacggtcgacgaaacaccatatattttggagagggaagttggctcactgttgtaggtgagtaagtcaaggctggacagctgggaacttgcaaaaaggggctggaatccagccatggataagtaacgctgatggcgcgagggaggc

SEQ ID NO: 1245 - DNA, 495 bp, Artificial Sequence
  Synthetic Template Oligonucleotide for TCRB Locus
gccttgccagcccgctcagccatggatgtctcctactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtctcctagtcgacaatgaaaaactgttttttggcagtggaacccagctctctgtcttgggtatgtaaaagacttctttcgggatagtgtatcataaggtcggagttccaggagccatggatgtctcctactgatggcgcgagggaggc

SEQ ID NO: 1246 - DNA, 495 bp, Artificial Sequence
  Synthetic Template Oligonucleotide for TCRB Locus
gccttgccagcccgctcagccatggatagagtgtcctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatagagtgtcgtcgacatcagccccagcattttggtgatgggactcgactctccatcctaggtaagttgcagaatcagggtggtatggccattgtcccttgaaggcagagttctctccatggatagagtgtcctgatggcgcgagggaggc

SEQ ID NO: 1247 - DNA, 495 bp, Artificial Sequence
  Synthetic Template Oligonucleotide for TCRB Locus
gccttgccagcccgctcagccatggatgttccgaactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgttccgaagtcgacataattcacccctccactttgggaacgggaccaggctcactgtgacaggtatgggggctccactcttgactcgggggtgcctgggtttgactgcaatgatccatggatgttccgaactgatggcgcgagggaggc

SEQ ID NO: 1248 - DNA, 495 bp, Artificial Sequence
  Synthetic Template Oligonucleotide for TCRB Locus
gccttgccagcccgctcagccatggatcgttacttctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatcgttacttgtcgacacaatgagcagttcttcgggccagggacacggctcaccgtgctaggtaagaagggggctccaggtgggagagagggtgagcagcccagcctgcacgacccccatggatcgttacttctgatggcgcgagggaggc

SEQ ID NO: 1249 - DNA, 495 bp, Artificial Sequence
  Synthetic Template Oligonucleotide for TCRB Locus
gccttgccagcccgctcagccatggattaggagacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggattaggagacgtcgacaccggggagctgttttttggagaaggctctaggctgaccgtactgggtaaggaggcggttggggctccggagagctccgagagggcgggatgggcagaggccatggattaggagacctgatggcgcgagggaggc

SEQ ID NO: 1250 - DNA, 495 bp, Artificial Sequence
  Synthetic Template Oligonucleotide for TCRB Locus
gccttgccagcccgctcagccatggatgtgtctacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtgtctacgtcgacagatacgcagtattttggcccaggcacccggctgacagtgctcggtaagcgggggctcccgctgaagccccggaactggggagggggcgccccgggacgcccatggatgtgtctacctgatggcgcgagggaggc

SEQ ID NO: 1251 - DNA, 495 bp, Artificial Sequence
  Synthetic Template Oligonucleotide for TCRB Locus
gccttgccagcccgctcagccatggatgtacagtgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtacagtggtcgacaaaacattcagtacttcggcgccgggacccggctctcagtgctgggtaagctggggccgccgggggaccggggacgagactgcgctcgggtttttgtgcgccatggatgtacagtgctgatggcgcgagggaggc

SEQ ID NO: 1252 - DNA, 495 bp, Artificial Sequence
  Synthetic Template Oligonucleotide for TCRB Locus
gccttgccagcccgctcagccatggatggatcatcctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatggatcatcgtcgacgagacccagtacttcgggccaggcacgcggctcctggtgctcggtgagcgcgggctgctggggcgcgggcgcgggcggcttgggtctggtttttgcggggccatggatggatcatcctgatggcgcgagggaggc

SEQ ID NO: 1253 - DNA, 495 bp, Artificial Sequence
  Synthetic Template Oligonucleotide for TCRB Locus
gccttgccagcccgctcagccatggattattggcgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggattattggcggtcgacgggccaacgtcctgactttcggggccggcagcaggctgaccgtgctgggtgagttttcgcgggaccacccgggcggcgggattcaggtggaaggcggcggccatggattattggcgctgatggcgcgagggaggc

SEQ ID NO: 1254 - DNA, 495 bp, Artificial Sequence
  Synthetic Template Oligonucleotide for TCRB Locus
gccttgccagcccgctcagccatggataggcttgactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggataggcttgagtcgacacgagcagtacttcgggccgggcaccaggctcacggtcacaggtgagattcgggcgtctccccaccttccagcccctcggtccccggagtcggagggtggccatggataggcttgactgatggcgcgagggaggc

SEQ ID NO: 1255 - DNA, 495 bp, Artificial Sequence
  Synthetic Template Oligonucleotide for TCRB Locus
gccttgccagcccgctcagactgctacgacactctctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgacactctgtcgacactgaagctttctttggacaaggcaccagactcacagttgtaggtaagacatttttcaggttcttttgcagatccgtcacagggaaaagtgggtccacagactgctacgacactctctgatggcgcgagggaggc

SEQ ID NO: 1256 - DNA, 495 bp, Artificial Sequence
  Synthetic Template Oligonucleotide for TCRB Locus
gccttgccagcccgctcagactgctacttcggaacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacttcggaacgtcgactatggctacaccttcggttcggggaccaggttaaccgttgtaggtaaggctgggggtctctaggaggggtgcgatgagggaggactctgtcctgggaaatactgctacttcggaacctgatggcgcgagggaggc

SEQ ID NO: 1257 - DNA, 495 bp, Artificial Sequence
  Synthetic Template Oligonucleotide for TCRB Locus
gccttgccagcccgctcagactgctacaagtaacgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacaagtaacggtcgacgaaacaccatatattttggagagggaagttggctcactgttgtaggtgagtaagtcaaggctggacagctgggaacttgcaaaaaggggctggaatccagactgctacaagtaacgctgatggcgcgagggaggc

SEQ ID NO: 1258 - DNA, 495 bp, Artificial Sequence
  Synthetic Template Oligonucleotide for TCRB Locus
gccttgccagcccgctcagactgctacgtctcctactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtctcctagtcgacaatgaaaaactgttttttggcagtggaacccagctctctgtcttgggtatgtaaaagacttctttcgggatagtgtatcataaggtcggagttccaggagactgctacgtctcctactgatggcgcgagggaggc

SEQ ID NO: 1259 - DNA, 495 bp, Artificial Sequence
  Synthetic Template Oligonucleotide for TCRB Locus
gccttgccagcccgctcagactgctacagagtgtcctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacagagtgtcgtcgacatcagccccagcattttggtgatgggactcgactctccatcctaggtaagttgcagaatcagggtggtatggccattgtcccttgaaggcagagttctctactgctacagagtgtcctgatggcgcgagggaggc

SEQ ID NO: 1260 - DNA, 495 bp, Artificial Sequence
  Synthetic Template Oligonucleotide for TCRB Locus
gccttgccagcccgctcagactgctacgttccgaactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgttccgaagtcgacataattcacccctccactttgggaacgggaccaggctcactgtgacaggtatgggggctccactcttgactcgggggtgcctgggtttgactgcaatgatactgctacgttccgaactgatggcgcgagggaggc

SEQ ID NO: 1261 - DNA, 495 bp, Artificial Sequence
  Synthetic Template Oligonucleotide for TCRB Locus
gccttgccagcccgctcagactgctaccgttacttctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctaccgttacttgtcgacacaatgagcagttcttcgggccagggacacggctcaccgtgctaggtaagaagggggctccaggtgggagagagggtgagcagcccagcctgcacgacccactgctaccgttacttctgatggcgcgagggaggc

SEQ ID NO: 1262 - DNA, 495 bp, Artificial Sequence
  Synthetic Template Oligonucleotide for TCRB Locus
gccttgccagcccgctcagactgctactaggagacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctactaggagacgtcgacaccggggagctgttttttggagaaggctctaggctgaccgtactgggtaaggaggcggttggggctccggagagctccgagagggcgggatgggcagaggactgctactaggagacctgatggcgcgagggaggc

SEQ ID NO: 1263 - DNA, 495 bp, Artificial Sequence
  Synthetic Template Oligonucleotide for TCRB Locus
gccttgccagcccgctcagactgctacgtgtctacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtgtctacgtcgacagatacgcagtattttggcccaggcacccggctgacagtgctcggtaagcgggggctcccgctgaagccccggaactggggagggggcgccccgggacgcactgctacgtgtctacctgatggcgcgagggaggc

SEQ ID NO: 1264 - DNA, 495 bp, Artificial Sequence
  Synthetic Template Oligonucleotide for TCRB Locus
gccttgccagcccgctcagactgctacgtacagtgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtacagtggtcgacaaaacattcagtacttcggcgccgggacccggctctcagtgctgggtaagctggggccgccgggggaccggggacgagactgcgctcgggtttttgtgcgactgctacgtacagtgctgatggcgcgagggaggc

SEQ ID NO: 1265 - DNA, 495 bp, Artificial Sequence
  Synthetic Template Oligonucleotide for TCRB Locus
gccttgccagcccgctcagactgctacggatcatcctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacggatcatcgtcgacgagacccagtacttcgggccaggcacgcggctcctggtgctcggtgagcgcgggctgctggggcgcgggcgcgggcggcttgggtctggtttttgcggggactgctacggatcatcctgatggcgcgagggaggc

SEQ ID NO: 1266 - DNA, 495 bp, Artificial Sequence
  Synthetic Template Oligonucleotide for TCRB Locus
gccttgccagcccgctcagactgctactattggcgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctactattggcggtcgacgggccaacgtcctgactttcggggccggcagcaggctgaccgtgctgggtgagttttcgcgggaccacccgggcggcgggattcaggtggaaggcggcggactgctactattggcgctgatggcgcgagggaggc

SEQ ID NO: 1267 - DNA, 495 bp, Artificial Sequence
  Synthetic Template Oligonucleotide for TCRB Locus
gccttgccagcccgctcagactgctacaggcttgactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacaggcttgagtcgacacgagcagtacttcgggccgggcaccaggctcacggtcacaggtgagattcgggcgtctccccaccttccagcccctcggtccccggagtcggagggtggactgctacaggcttgactgatggcgcgagggaggc

SEQ ID NO: 1268 - DNA, 495 bp, Artificial Sequence
  Synthetic Template Oligonucleotide for TCRB Locus
gccttgccagcccgctcagacgaagatgacactctttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgacactctgtcgacactgaagctttctttggacaaggcaccagactcacagttgtaggtaagacatttttcaggttcttttgcagatccgtcacagggaaaagtgggtccacagacgaagatgacactctctgatggcgcgagggaggc

SEQ ID NO: 1269 - DNA, 495 bp, Artificial Sequence
  Synthetic Template Oligonucleotide for TCRB Locus
gccttgccagcccgctcagacgaagatttcggaacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatttcggaacgtcgactatggctacaccttcggttcggggaccaggttaaccgttgtaggtaaggctgggggtctctaggaggggtgcgatgagggaggactctgtcctgggaaatacgaagatttcggaacctgatggcgcgagggaggc

SEQ ID NO: 1270 - DNA, 495 bp, Artificial Sequence
  Synthetic Template Oligonucleotide for TCRB Locus
gccttgccagcccgctcagacgaagataagtaacgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagataagtaacggtcgacgaaacaccatatattttggagagggaagttggctcactgttgtaggtgagtaagtcaaggctggacagctgggaacttgcaaaaaggggctggaatccagacgaagataagtaacgctgatggcgcgagggaggc

SEQ ID NO: 1271 - DNA, 495 bp, Artificial Sequence
  Synthetic Template Oligonucleotide for TCRB Locus
gccttgccagcccgctcagacgaagatgtctcctattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtctcctagtcgacaatgaaaaactgttttttggcagtggaacccagctctctgtcttgggtatgtaaaagacttctttcgggatagtgtatcataaggtcggagttccaggagacgaagatgtctcctactgatggcgcgagggaggc

SEQ ID NO: 1272 - DNA, 495 bp, Artificial Sequence
  Synthetic Template Oligonucleotide for TCRB Locus
gccttgccagcccgctcagacgaagatagagtgtcttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatagagtgtcgtcgacatcagccccagcattttggtgatgggactcgactctccatcctaggtaagttgcagaatcagggtggtatggccattgtcccttgaaggcagagttctctacgaagatagagtgtcctgatggcgcgagggaggc

SEQ ID NO: 1273 - DNA, 495 bp, Artificial Sequence
  Synthetic Template Oligonucleotide for TCRB Locus
gccttgccagcccgctcagacgaagatgttccgaattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgttccgaagtcgacataattcacccctccactttgggaacgggaccaggctcactgtgacaggtatgggggctccactcttgactcgggggtgcctgggtttgactgcaatgatacgaagatgttccgaactgatggcgcgagggaggc

SEQ ID NO: 1274 - DNA, 495 bp, Artificial Sequence
  Synthetic Template Oligonucleotide for TCRB Locus
gccttgccagcccgctcagacgaagatcgttacttttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatcgttacttgtcgacacaatgagcagttcttcgggccagggacacggctcaccgtgctaggtaagaagggggctccaggtgggagagagggtgagcagcccagcctgcacgacccacgaagatcgttacttctgatggcgcgagggaggc

SEQ ID NO: 1275 - DNA, 495 bp, Artificial Sequence
  Synthetic Template Oligonucleotide for TCRB Locus
gccttgccagcccgctcagacgaagattaggagacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagattaggagacgtcgacaccggggagctgttttttggagaaggctctaggctgaccgtactgggtaaggaggcggttggggctccggagagctccgagagggcgggatgggcagaggacgaagattaggagacctgatggcgcgagggaggc

SEQ ID NO: 1276 - DNA, 495 bp, Artificial Sequence
  Synthetic Template Oligonucleotide for TCRB Locus
gccttgccagcccgctcagacgaagatgtgtctacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtgtctacgtcgacagatacgcagtattttggcccaggcacccggctgacagtgctcggtaagcgggggctcccgctgaagccccggaactggggagggggcgccccgggacgcacgaagatgtgtctacctgatggcgcgagggaggc

SEQ ID NO: 1277 - DNA, 495 bp, Artificial Sequence
  Synthetic Template Oligonucleotide for TCRB Locus
gccttgccagcccgctcagacgaagatgtacagtgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtacagtggtcgacaaaacattcagtacttcggcgccgggacccggctctcagtgctgggtaagctggggccgccgggggaccggggacgagactgcgctcgggtttttgtgcgacgaagatgtacagtgctgatggcgcgagggaggc

SEQ ID NO: 1278 - DNA, 495 bp, Artificial Sequence
  Synthetic Template Oligonucleotide for TCRB Locus
gccttgccagcccgctcagacgaagatggatcatcttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatggatcatcgtcgacgagacccagtacttcgggccaggcacgcggctcctggtgctcggtgagcgcgggctgctggggcgcgggcgcgggcggcttgggtctggtttttgcggggacgaagatggatcatcctgatggcgcgagggaggc

SEQ ID NO: 1279 - DNA, 495 bp, Artificial Sequence
  Synthetic Template Oligonucleotide for TCRB Locus
gccttgccagcccgctcagacgaagattattggcgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagattattggcggtcgacgggccaacgtcctgactttcggggccggcagcaggctgaccgtgctgggtgagttttcgcgggaccacccgggcggcgggattcaggtggaaggcggcggacgaagattattggcgctgatggcgcgagggaggc

SEQ ID NO: 1280 - DNA, 495 bp, Artificial Sequence
  Synthetic Template Oligonucleotide for TCRB Locus
gccttgccagcccgctcagacgaagataggcttgattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagataggcttgagtcgacacgagcagtacttcgggccgggcaccaggctcacggtcacaggtgagattcgggcgtctccccaccttccagcccctcggtccccggagtcggagggtggacgaagataggcttgactgatggcgcgagggaggc

SEQ ID NO: 1281 - DNA, 495 bp, Artificial Sequence
  Synthetic Template Oligonucleotide for TCRB Locus
gccttgccagcccgctcagactgtggagacactctcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagacactctgtcgacactgaagctttctttggacaaggcaccagactcacagttgtaggtaagacatttttcaggttcttttgcagatccgtcacagggaaaagtgggtccacagactgtggagacactctctgatggcgcgagggaggc

SEQ ID NO: 1282 - DNA, 495 bp, Artificial Sequence
  Synthetic Template Oligonucleotide for TCRB Locus
gccttgccagcccgctcagactgtggattcggaaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggattcggaacgtcgactatggctacaccttcggttcggggaccaggttaaccgttgtaggtaaggctgggggtctctaggaggggtgcgatgagggaggactctgtcctgggaaatactgtggattcggaacctgatggcgcgagggaggc

SEQ ID NO: 1283 - DNA, 495 bp, Artificial Sequence
  Synthetic Template Oligonucleotide for TCRB Locus
gccttgccagcccgctcagactgtggaaagtaacgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaaagtaacggtcgacgaaacaccatatattttggagagggaagttggctcactgttgtaggtgagtaagtcaaggctggacagctgggaacttgcaaaaaggggctggaatccagactgtggaaagtaacgctgatggcgcgagggaggc

SEQ ID NO: 1284 - DNA, 495 bp, Artificial Sequence
  Synthetic Template Oligonucleotide for TCRB Locus
gccttgccagcccgctcagactgtggagtctcctacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtctcctagtcgacaatgaaaaactgttttttggcagtggaacccagctctctgtcttgggtatgtaaaagacttctttcgggatagtgtatcataaggtcggagttccaggagactgtggagtctcctactgatggcgcgagggaggc

SEQ ID NO: 1285 - DNA, 495 bp, Artificial Sequence
  Synthetic Template Oligonucleotide for TCRB Locus
gccttgccagcccgctcagactgtggaagagtgtccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaagagtgtcgtcgacatcagccccagcattttggtgatgggactcgactctccatcctaggtaagttgcagaatcagggtggtatggccattgtcccttgaaggcagagttctctactgtggaagagtgtcctgatggcgcgagggaggc

SEQ ID NO: 1286 - DNA, 495 bp, Artificial Sequence
  Synthetic Template Oligonucleotide for TCRB Locus
gccttgccagcccgctcagactgtggagttccgaacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagttccgaagtcgacataattcacccctccactttgggaacgggaccaggctcactgtgacaggtatgggggctccactcttgactcgggggtgcctgggtttgactgcaatgatactgtggagttccgaactgatggcgcgagggaggc

SEQ ID NO: 1287 - DNA, 495 bp, Artificial Sequence
  Synthetic Template Oligonucleotide for TCRB Locus
gccttgccagcccgctcagactgtggacgttacttcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggacgttacttgtcgacacaatgagcagttcttcgggccagggacacggctcaccgtgctaggtaagaagggggctccaggtgggagagagggtgagcagcccagcctgcacgacccactgtggacgttacttctgatggcgcgagggaggc

SEQ ID NO: 1288 - DNA, 495 bp, Artificial Sequence
  Synthetic Template Oligonucleotide for TCRB Locus
gccttgccagcccgctcagactgtggataggagaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggataggagacgtcgacaccggggagctgttttttggagaaggctctaggctgaccgtactgggtaaggaggcggttggggctccggagagctccgagagggcgggatgggcagaggactgtggataggagacctgatggcgcgagggaggc

SEQ ID NO: 1289 - DNA, 495 bp, Artificial Sequence
  Synthetic Template Oligonucleotide for TCRB Locus
gccttgccagcccgctcagactgtggagtgtctaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtgtctacgtcgacagatacgcagtattttggcccaggcacccggctgacagtgctcggtaagcgggggctcccgctgaagccccggaactggggagggggcgccccgggacgcactgtggagtgtctacctgatggcgcgagggaggc

SEQ ID NO: 1290 - DNA, 495 bp, Artificial Sequence
  Synthetic Template Oligonucleotide for TCRB Locus
gccttgccagcccgctcagactgtggagtacagtgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtacagtggtcgacaaaacattcagtacttcggcgccgggacccggctctcagtgctgggtaagctggggccgccgggggaccggggacgagactgcgctcgggtttttgtgcgactgtggagtacagtgctgatggcgcgagggaggc

SEQ ID NO: 1291 - DNA, 495 bp, Artificial Sequence
  Synthetic Template Oligonucleotide for TCRB Locus
gccttgccagcccgctcagactgtggaggatcatccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaggatcatcgtcgacgagacccagtacttcgggccaggcacgcggctcctggtgctcggtgagcgcgggctgctggggcgcgggcgcgggcggcttgggtctggtttttgcggggactgtggaggatcatcctgatggcgcgagggaggc

SEQ ID NO: 1292 - DNA, 495 bp, Artificial Sequence
  Synthetic Template Oligonucleotide for TCRB Locus
gccttgccagcccgctcagactgtggatattggcgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggatattggcggtcgacgggccaacgtcctgactttcggggccggcagcaggctgaccgtgctgggtgagttttcgcgggaccacccgggcggcgggattcaggtggaaggcggcggactgtggatattggcgctgatggcgcgagggaggc

SEQ ID NO: 1293 - DNA, 495 bp, Artificial Sequence
  Synthetic Template Oligonucleotide for TCRB Locus
gccttgccagcccgctcagactgtggaaggcttgacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaaggcttgagtcgacacgagcagtacttcgggccgggcaccaggctcacggtcacaggtgagattcgggcgtctccccaccttccagcccctcggtccccggagtcggagggtggactgtggaaggcttgactgatggcgcgagggaggc

SEQ ID NO: 1294 - DNA, 495 bp, Artificial Sequence
  Synthetic Template Oligonucleotide for TCRB Locus
gccttgccagcccgctcagggtgtcatgacactctcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgacactctgtcgacactgaagctttctttggacaaggcaccagactcacagttgtaggtaagacatttttcaggttcttttgcagatccgtcacagggaaaagtgggtccacagggtgtcatgacactctctgatggcgcgagggaggc

SEQ ID NO: 1295 - DNA, 495 bp, Artificial Sequence
  Synthetic Template Oligonucleotide for TCRB Locus
gccttgccagcccgctcagggtgtcatttcggaaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatttcggaacgtcgactatggctacaccttcggttcggggaccaggttaaccgttgtaggtaaggctgggggtctctaggaggggtgcgatgagggaggactctgtcctgggaaatggtgtcatttcggaacctgatggcgcgagggaggc

SEQ ID NO: 1296 - DNA, 495 bp, Artificial Sequence
  Synthetic Template Oligonucleotide for TCRB Locus
gccttgccagcccgctcagggtgtcataagtaacgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcataagtaacggtcgacgaaacaccatatattttggagagggaagttggctcactgttgtaggtgagtaagtcaaggctggacagctgggaacttgcaaaaaggggctggaatccagggtgtcataagtaacgctgatggcgcgagggaggc

SEQ ID NO: 1297 - DNA, 495 bp, Artificial Sequence
  Synthetic Template Oligonucleotide for TCRB Locus
gccttgccagcccgctcagggtgtcatgtctcctacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtctcctagtcgacaatgaaaaactgttttttggcagtggaacccagctctctgtcttgggtatgtaaaagacttctttcgggatagtgtatcataaggtcggagttccaggagggtgtcatgtctcctactgatggcgcgagggaggc

SEQ ID NO: 1298 - DNA, 495 bp, Artificial Sequence
  Synthetic Template Oligonucleotide for TCRB Locus
gccttgccagcccgctcagggtgtcatagagtgtccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatagagtgtcgtcgacatcagccccagcattttggtgatgggactcgactctccatcctaggtaagttgcagaatcagggtggtatggccattgtcccttgaaggcagagttctctggtgtcatagagtgtcctgatggcgcgagggaggc

SEQ ID NO: 1299 - DNA, 495 bp, Artificial Sequence
  Synthetic Template Oligonucleotide for TCRB Locus
gccttgccagcccgctcagggtgtcatgttccgaacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgttccgaagtcgacataattcacccctccactttgggaacgggaccaggctcactgtgacaggtatgggggctccactcttgactcgggggtgcctgggtttgactgcaatgatggtgtcatgttccgaactgatggcgcgagggaggc

SEQ ID NO: 1300 - DNA, 495 bp, Artificial Sequence
  Synthetic Template Oligonucleotide for TCRB Locus
gccttgccagcccgctcagggtgtcatcgttacttcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatcgttacttgtcgacacaatgagcagttcttcgggccagggacacggctcaccgtgctaggtaagaagggggctccaggtgggagagagggtgagcagcccagcctgcacgacccggtgtcatcgttacttctgatggcgcgagggaggc

SEQ ID NO: 1301 - DNA, 495 bp, Artificial Sequence
  Synthetic Template Oligonucleotide for TCRB Locus
gccttgccagcccgctcagggtgtcattaggagaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcattaggagacgtcgacaccggggagctgttttttggagaaggctctaggctgaccgtactgggtaaggaggcggttggggctccggagagctccgagagggcgggatgggcagaggggtgtcattaggagacctgatggcgcgagggaggc

SEQ ID NO: 1302 - DNA, 495 bp, Artificial Sequence
  Synthetic Template Oligonucleotide for TCRB Locus
gccttgccagcccgctcagggtgtcatgtgtctaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtgtctacgtcgacagatacgcagtattttggcccaggcacccggctgacagtgctcggtaagcgggggctcccgctgaagccccggaactggggagggggcgccccgggacgcggtgtcatgtgtctacctgatggcgcgagggaggc

SEQ ID NO: 1303 - DNA, 495 bp, Artificial Sequence
  Synthetic Template Oligonucleotide for TCRB Locus
gccttgccagcccgctcagggtgtcatgtacagtgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtacagtggtcgacaaaacattcagtacttcggcgccgggacccggctctcagtgctgggtaagctggggccgccgggggaccggggacgagactgcgctcgggtttttgtgcgggtgtcatgtacagtgctgatggcgcgagggaggc

SEQ ID NO: 1304 - DNA, 495 bp, Artificial Sequence
  Synthetic Template Oligonucleotide for TCRB Locus
gccttgccagcccgctcagggtgtcatggatcatccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatggatcatcgtcgacgagacccagtacttcgggccaggcacgcggctcctggtgctcggtgagcgcgggctgctggggcgcgggcgcgggcggcttgggtctggtttttgcggggggtgtcatggatcatcctgatggcgcgagggaggc

SEQ ID NO: 1305 - DNA, 495 bp, Artificial Sequence
  Synthetic Template Oligonucleotide for TCRB Locus
gccttgccagcccgctcagggtgtcattattggcgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcattattggcggtcgacgggccaacgtcctgactttcggggccggcagcaggctgaccgtgctgggtgagttttcgcgggaccacccgggcggcgggattcaggtggaaggcggcggggtgtcattattggcgctgatggcgcgagggaggc

SEQ ID NO: 1306 - DNA, 495 bp, Artificial Sequence
  Synthetic Template Oligonucleotide for TCRB Locus
gccttgccagcccgctcagggtgtcataggcttgacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcataggcttgagtcgacacgagcagtacttcgggccgggcaccaggctcacggtcacaggtgagattcgggcgtctccccaccttccagcccctcggtccccggagtcggagggtggggtgtcataggcttgactgatggcgcgagggaggc

SEQ ID NO: 1307 - DNA, 495 bp, Artificial Sequence
  Synthetic Template Oligonucleotide for TCRB Locus
gccttgccagcccgctcagtcgtgaaggacactctccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggacactctgtcgacactgaagctttctttggacaaggcaccagactcacagttgtaggtaagacatttttcaggttcttttgcagatccgtcacagggaaaagtgggtccacagtcgtgaaggacactctctgatggcgcgagggaggc

SEQ ID NO: 1308 - DNA, 495 bp, Artificial Sequence
  Synthetic Template Oligonucleotide for TCRB Locus
gccttgccagcccgctcagtcgtgaagttcggaacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagttcggaacgtcgactatggctacaccttcggttcggggaccaggttaaccgttgtaggtaaggctgggggtctctaggaggggtgcgatgagggaggactctgtcctgggaaattcgtgaagttcggaacctgatggcgcgagggaggc

SEQ ID NO: 1309 - DNA, 495 bp, Artificial Sequence
  Synthetic Template Oligonucleotide for TCRB Locus
gccttgccagcccgctcagtcgtgaagaagtaacgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagaagtaacggtcgacgaaacaccatatattttggagagggaagttggctcactgttgtaggtgagtaagtcaaggctggacagctgggaacttgcaaaaaggggctggaatccagtcgtgaagaagtaacgctgatggcgcgagggaggc

SEQ ID NO: 1310 - DNA, 495 bp, Artificial Sequence
  Synthetic Template Oligonucleotide for TCRB Locus
gccttgccagcccgctcagtcgtgaaggtctcctaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtctcctagtcgacaatgaaaaactgttttttggcagtggaacccagctctctgtcttgggtatgtaaaagacttctttcgggatagtgtatcataaggtcggagttccaggagtcgtgaaggtctcctactgatggcgcgagggaggc

SEQ ID NO: 1311 - DNA, 495 bp, Artificial Sequence
  Synthetic Template Oligonucleotide for TCRB Locus
gccttgccagcccgctcagtcgtgaagagagtgtcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagagagtgtcgtcgacatcagccccagcattttggtgatgggactcgactctccatcctaggtaagttgcagaatcagggtggtatggccattgtcccttgaaggcagagttctcttcgtgaagagagtgtcctgatggcgcgagggaggc

SEQ ID NO: 1312 - DNA, 495 bp, Artificial Sequence
  Synthetic Template Oligonucleotide for TCRB Locus
gccttgccagcccgctcagtcgtgaaggttccgaaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggttccgaagtcgacataattcacccctccactttgggaacgggaccaggctcactgtgacaggtatgggggctccactcttgactcgggggtgcctgggtttgactgcaatgattcgtgaaggttccgaactgatggcgcgagggaggc

SEQ ID NO: 1313 - DNA, 495 bp, Artificial Sequence
  Synthetic Template Oligonucleotide for TCRB Locus
gccttgccagcccgctcagtcgtgaagcgttacttccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagcgttacttgtcgacacaatgagcagttcttcgggccagggacacggctcaccgtgctaggtaagaagggggctccaggtgggagagagggtgagcagcccagcctgcacgaccctcgtgaagcgttacttctgatggcgcgagggaggc

SEQ ID NO: 1314 - DNA, 495 bp, Artificial Sequence
  Synthetic Template Oligonucleotide for TCRB Locus
gccttgccagcccgctcagtcgtgaagtaggagacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagtaggagacgtcgacaccggggagctgttttttggagaaggctctaggctgaccgtactgggtaaggaggcggttggggctccggagagctccgagagggcgggatgggcagaggtcgtgaagtaggagacctgatggcgcgagggaggc

SEQ ID NO: 1315 - DNA, 495 bp, Artificial Sequence
  Synthetic Template Oligonucleotide for TCRB Locus
gccttgccagcccgctcagtcgtgaaggtgtctacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtgtctacgtcgacagatacgcagtattttggcccaggcacccggctgacagtgctcggtaagcgggggctcccgctgaagccccggaactggggagggggcgccccgggacgctcgtgaaggtgtctacctgatggcgcgagggaggc

SEQ ID NO: 1316 - DNA, 495 bp, Artificial Sequence
  Synthetic Template Oligonucleotide for TCRB Locus
gccttgccagcccgctcagtcgtgaaggtacagtgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtacagtggtcgacaaaacattcagtacttcggcgccgggacccggctctcagtgctgggtaagctggggccgccgggggaccggggacgagactgcgctcgggtttttgtgcgtcgtgaaggtacagtgctgatggcgcgagggaggc

SEQ ID NO: 1317 - DNA, 495 bp, Artificial Sequence
  Synthetic Template Oligonucleotide for TCRB Locus
gccttgccagcccgctcagtcgtgaagggatcatcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagggatcatcgtcgacgagacccagtacttcgggccaggcacgcggctcctggtgctcggtgagcgcgggctgctggggcgcgggcgcgggcggcttgggtctggtttttgcggggtcgtgaagggatcatcctgatggcgcgagggaggc

SEQ ID NO: 1318 - DNA, 495 bp, Artificial Sequence
  Synthetic Template Oligonucleotide for TCRB Locus
gccttgccagcccgctcagtcgtgaagtattggcgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagtattggcggtcgacgggccaacgtcctgactttcggggccggcagcaggctgaccgtgctgggtgagttttcgcgggaccacccgggcggcgggattcaggtggaaggcggcggtcgtgaagtattggcgctgatggcgcgagggaggc

SEQ ID NO: 1319 - DNA, 495 bp, Artificial Sequence
  Synthetic Template Oligonucleotide for TCRB Locus
gccttgccagcccgctcagtcgtgaagaggcttgaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagaggcttgagtcgacacgagcagtacttcgggccgggcaccaggctcacggtcacaggtgagattcgggcgtctccccaccttccagcccctcggtccccggagtcggagggtggtcgtgaagaggcttgactgatggcgcgagggaggc

SEQ ID NO: 1320 - DNA, 495 bp, Artificial Sequence
  Synthetic Template Oligonucleotide for TCRB Locus
gccttgccagcccgctcagcactagctgacactctttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgacactctgtcgacactgaagctttctttggacaaggcaccagactcacagttgtaggtaagacatttttcaggttcttttgcagatccgtcacagggaaaagtgggtccacagcactagctgacactctctgatggcgcgagggaggc

SEQ ID NO: 1321 - DNA, 495 bp, Artificial Sequence
  Synthetic Template Oligonucleotide for TCRB Locus
gccttgccagcccgctcagcactagctttcggaacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctttcggaacgtcgactatggctacaccttcggttcggggaccaggttaaccgttgtaggtaaggctgggggtctctaggaggggtgcgatgagggaggactctgtcctgggaaatcactagctttcggaacctgatggcgcgagggaggc

SEQ ID NO: 1322 - DNA, 495 bp, Artificial Sequence
  Synthetic Template Oligonucleotide for TCRB Locus
gccttgccagcccgctcagcactagctaagtaacgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctaagtaacggtcgacgaaacaccatatattttggagagggaagttggctcactgttgtaggtgagtaagtcaaggctggacagctgggaacttgcaaaaaggggctggaatccagcactagctaagtaacgctgatggcgcgagggaggc

SEQ ID NO: 1323 - DNA, 495 bp, Artificial Sequence
  Synthetic Template Oligonucleotide for TCRB Locus
gccttgccagcccgctcagcactagctgtctcctattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtctcctagtcgacaatgaaaaactgttttttggcagtggaacccagctctctgtcttgggtatgtaaaagacttctttcgggatagtgtatcataaggtcggagttccaggagcactagctgtctcctactgatggcgcgagggaggc

SEQ ID NO: 1324 - DNA, 495 bp, Artificial Sequence
  Synthetic Template Oligonucleotide for TCRB Locus
gccttgccagcccgctcagcactagctagagtgtcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctagagtgtcgtcgacatcagccccagcattttggtgatgggactcgactctccatcctaggtaagttgcagaatcagggtggtatggccattgtcccttgaaggcagagttctctcactagctagagtgtcctgatggcgcgagggaggc

SEQ ID NO: 1325 - DNA, 495 bp, Artificial Sequence
  Synthetic Template Oligonucleotide for TCRB Locus
gccttgccagcccgctcagcactagctgttccgaattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgttccgaagtcgacataattcacccctccactttgggaacgggaccaggctcactgtgacaggtatgggggctccactcttgactcgggggtgcctgggtttgactgcaatgatcactagctgttccgaactgatggcgcgagggaggc

SEQ ID NO: 1326 - DNA, 495 bp, Artificial Sequence
  Synthetic Template Oligonucleotide for TCRB Locus
gccttgccagcccgctcagcactagctcgttacttttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctcgttacttgtcgacacaatgagcagttcttcgggccagggacacggctcaccgtgctaggtaagaagggggctccaggtgggagagagggtgagcagcccagcctgcacgaccccactagctcgttacttctgatggcgcgagggaggc

SEQ ID NO: 1327 - DNA, 495 bp, Artificial Sequence
  Synthetic Template Oligonucleotide for TCRB Locus
gccttgccagcccgctcagcactagcttaggagacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagcttaggagacgtcgacaccggggagctgttttttggagaaggctctaggctgaccgtactgggtaaggaggcggttggggctccggagagctccgagagggcgggatgggcagaggcactagcttaggagacctgatggcgcgagggaggc

SEQ ID NO: 1328 - DNA, 495 bp, Artificial Sequence
  Synthetic Template Oligonucleotide for TCRB Locus
gccttgccagcccgctcagcactagctgtgtctacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtgtctacgtcgacagatacgcagtattttggcccaggcacccggctgacagtgctcggtaagcgggggctcccgctgaagccccggaactggggagggggcgccccgggacgccactagctgtgtctacctgatggcgcgagggaggc

SEQ ID NO: 1329 - DNA, 495 bp, Artificial Sequence
  Synthetic Template Oligonucleotide for TCRB Locus
gccttgccagcccgctcagcactagctgtacagtgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtacagtggtcgacaaaacattcagtacttcggcgccgggacccggctctcagtgctgggtaagctggggccgccgggggaccggggacgagactgcgctcgggtttttgtgcgcactagctgtacagtgctgatggcgcgagggaggc

SEQ ID NO: 1330 - DNA, 495 bp, Artificial Sequence
  Synthetic Template Oligonucleotide for TCRB Locus
gccttgccagcccgctcagcactagctggatcatcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctggatcatcgtcgacgagacccagtacttcgggccaggcacgcggctcctggtgctcggtgagcgcgggctgctggggcgcgggcgcgggcggcttgggtctggtttttgcggggcactagctggatcatcctgatggcgcgagggaggc

SEQ ID NO: 1331 - DNA, 495 bp, Artificial Sequence
  Synthetic Template Oligonucleotide for TCRB Locus
gccttgccagcccgctcagcactagcttattggcgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagcttattggcggtcgacgggccaacgtcctgactttcggggccggcagcaggctgaccgtgctgggtgagttttcgcgggaccacccgggcggcgggattcaggtggaaggcggcggcactagcttattggcgctgatggcgcgagggaggc

SEQ ID NO: 1332 - DNA, 495 bp, Artificial Sequence
  Synthetic Template Oligonucleotide for TCRB Locus
gccttgccagcccgctcagcactagctaggcttgattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctaggcttgagtcgacacgagcagtacttcgggccgggcaccaggctcacggtcacaggtgagattcgggcgtctccccaccttccagcccctcggtccccggagtcggagggtggcactagctaggcttgactgatggcgcgagggaggc

SEQ ID NO: 1333 - DNA, 495 bp, Artificial Sequence
  Synthetic Template Oligonucleotide for TCRB Locus
gccttgccagcccgctcagcttggttagacactctttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagacactctgtcgacactgaagctttctttggacaaggcaccagactcacagttgtaggtaagacatttttcaggttcttttgcagatccgtcacagggaaaagtgggtccacagcttggttagacactctctgatggcgcgagggaggc

SEQ ID NO: 1334 - DNA, 495 bp, Artificial Sequence
  Synthetic Template Oligonucleotide for TCRB Locus
gccttgccagcccgctcagcttggttattcggaacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttattcggaacgtcgactatggctacaccttcggttcggggaccaggttaaccgttgtaggtaaggctgggggtctctaggaggggtgcgatgagggaggactctgtcctgggaaatcttggttattcggaacctgatggcgcgagggaggc

SEQ ID NO: 1335 - DNA, 495 bp, Artificial Sequence
  Synthetic Template Oligonucleotide for TCRB Locus
gccttgccagcccgctcagcttggttaaagtaacgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaaagtaacggtcgacgaaacaccatatattttggagagggaagttggctcactgttgtaggtgagtaagtcaaggctggacagctgggaacttgcaaaaaggggctggaatccagcttggttaaagtaacgctgatggcgcgagggaggc

SEQ ID NO: 1336 - DNA, 495 bp, Artificial Sequence
  Synthetic Template Oligonucleotide for TCRB Locus
gccttgccagcccgctcagcttggttagtctcctattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtctcctagtcgacaatgaaaaactgttttttggcagtggaacccagctctctgtcttgggtatgtaaaagacttctttcgggatagtgtatcataaggtcggagttccaggagcttggttagtctcctactgatggcgcgagggaggc

SEQ ID NO: 1337 - DNA, 495 bp, Artificial Sequence
  Synthetic Template Oligonucleotide for TCRB Locus
gccttgccagcccgctcagcttggttaagagtgtcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaagagtgtcgtcgacatcagccccagcattttggtgatgggactcgactctccatcctaggtaagttgcagaatcagggtggtatggccattgtcccttgaaggcagagttctctcttggttaagagtgtcctgatggcgcgagggaggc

SEQ ID NO: 1338 - DNA, 495 bp, Artificial Sequence
  Synthetic Template Oligonucleotide for TCRB Locus
gccttgccagcccgctcagcttggttagttccgaattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagttccgaagtcgacataattcacccctccactttgggaacgggaccaggctcactgtgacaggtatgggggctccactcttgactcgggggtgcctgggtttgactgcaatgatcttggttagttccgaactgatggcgcgagggaggc

SEQ ID NO: 1339 - DNA, 495 bp, Artificial Sequence
  Synthetic Template Oligonucleotide for TCRB Locus
gccttgccagcccgctcagcttggttacgttacttttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttacgttacttgtcgacacaatgagcagttcttcgggccagggacacggctcaccgtgctaggtaagaagggggctccaggtgggagagagggtgagcagcccagcctgcacgaccccttggttacgttacttctgatggcgcgagggaggc

SEQ ID NO: 1340 - DNA, 495 bp, Artificial Sequence
  Synthetic Template Oligonucleotide for TCRB Locus
gccttgccagcccgctcagcttggttataggagacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttataggagacgtcgacaccggggagctgttttttggagaaggctctaggctgaccgtactgggtaaggaggcggttggggctccggagagctccgagagggcgggatgggcagaggcttggttataggagacctgatggcgcgagggaggc

SEQ ID NO: 1341 - DNA, 495 bp, Artificial Sequence
  Synthetic Template Oligonucleotide for TCRB Locus
gccttgccagcccgctcagcttggttagtgtctacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtgtctacgtcgacagatacgcagtattttggcccaggcacccggctgacagtgctcggtaagcgggggctcccgctgaagccccggaactggggagggggcgccccgggacgccttggttagtgtctacctgatggcgcgagggaggc

SEQ ID NO: 1342 - DNA, 495 bp, Artificial Sequence
  Synthetic Template Oligonucleotide for TCRB Locus
gccttgccagcccgctcagcttggttagtacagtgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtacagtggtcgacaaaacattcagtacttcggcgccgggacccggctctcagtgctgggtaagctggggccgccgggggaccggggacgagactgcgctcgggtttttgtgcgcttggttagtacagtgctgatggcgcgagggaggc

SEQ ID NO: 1343 - DNA, 495 bp, Artificial Sequence
  Synthetic Template Oligonucleotide for TCRB Locus
gccttgccagcccgctcagcttggttaggatcatcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaggatcatcgtcgacgagacccagtacttcgggccaggcacgcggctcctggtgctcggtgagcgcgggctgctggggcgcgggcgcgggcggcttgggtctggtttttgcggggcttggttaggatcatcctgatggcgcgagggaggc

SEQ ID NO: 1344 - DNA, 495 bp, Artificial Sequence
  Synthetic Template Oligonucleotide for TCRB Locus
gccttgccagcccgctcagcttggttatattggcgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttatattggcggtcgacgggccaacgtcctgactttcggggccggcagcaggctgaccgtgctgggtgagttttcgcgggaccacccgggcggcgggattcaggtggaaggcggcggcttggttatattggcgctgatggcgcgagggaggc

SEQ ID NO: 1345 - DNA, 495 bp, Artificial Sequence
  Synthetic Template Oligonucleotide for TCRB Locus
gccttgccagcccgctcagcttggttaaggcttgattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaaggcttgagtcgacacgagcagtacttcgggccgggcaccaggctcacggtcacaggtgagattcgggcgtctccccaccttccagcccctcggtccccggagtcggagggtggcttggttaaggcttgactgatggcgcgagggaggc

SEQ ID NO: 1346 - DNA, 495 bp, Artificial Sequence
  Synthetic Template Oligonucleotide for TCRB Locus
gccttgccagcccgctcagacctcttggacactcttttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggacactctgtcgacactgaagctttctttggacaaggcaccagactcacagttgtaggtaagacatttttcaggttcttttgcagatccgtcacagggaaaagtgggtccacagacctcttggacactctctgatggcgcgagggaggc

SEQ ID NO: 1347 - DNA, 495 bp, Artificial Sequence
  Synthetic Template Oligonucleotide for TCRB Locus
gccttgccagcccgctcagacctcttgttcggaactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgttcggaacgtcgactatggctacaccttcggttcggggaccaggttaaccgttgtaggtaaggctgggggtctctaggaggggtgcgatgagggaggactctgtcctgggaaatacctcttgttcggaacctgatggcgcgagggaggc

SEQ ID NO: 1348 - DNA, 495 bp, Artificial Sequence
  Synthetic Template Oligonucleotide for TCRB Locus
gccttgccagcccgctcagacctcttgaagtaacgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgaagtaacggtcgacgaaacaccatatattttggagagggaagttggctcactgttgtaggtgagtaagtcaaggctggacagctgggaacttgcaaaaaggggctggaatccagacctcttgaagtaacgctgatggcgcgagggaggc

SEQ ID NO: 1349 - DNA, 495 bp, Artificial Sequence
  Synthetic Template Oligonucleotide for TCRB Locus
gccttgccagcccgctcagacctcttggtctcctatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtctcctagtcgacaatgaaaaactgttttttggcagtggaacccagctctctgtcttgggtatgtaaaagacttctttcgggatagtgtatcataaggtcggagttccaggagacctcttggtctcctactgatggcgcgagggaggc

SEQ ID NO: 1350 - DNA, 495 bp, Artificial Sequence
  Synthetic Template Oligonucleotide for TCRB Locus
gccttgccagcccgctcagacctcttgagagtgtctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgagagtgtcgtcgacatcagccccagcattttggtgatgggactcgactctccatcctaggtaagttgcagaatcagggtggtatggccattgtcccttgaaggcagagttctctacctcttgagagtgtcctgatggcgcgagggaggc

SEQ ID NO: 1351 - DNA, 495 bp, Artificial Sequence
  Synthetic Template Oligonucleotide for TCRB Locus
gccttgccagcccgctcagacctcttggttccgaatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggttccgaagtcgacataattcacccctccactttgggaacgggaccaggctcactgtgacaggtatgggggctccactcttgactcgggggtgcctgggtttgactgcaatgatacctcttggttccgaactgatggcgcgagggaggc

SEQ ID NO: 1352 - DNA, 495 bp, Artificial Sequence
  Synthetic Template Oligonucleotide for TCRB Locus
gccttgccagcccgctcagacctcttgcgttactttttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgcgttacttgtcgacacaatgagcagttcttcgggccagggacacggctcaccgtgctaggtaagaagggggctccaggtgggagagagggtgagcagcccagcctgcacgacccacctcttgcgttacttctgatggcgcgagggaggc

SEQ ID NO: 1353 - DNA, 495 bp, Artificial Sequence
  Synthetic Template Oligonucleotide for TCRB Locus
gccttgccagcccgctcagacctcttgtaggagactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgtaggagacgtcgacaccggggagctgttttttggagaaggctctaggctgaccgtactgggtaaggaggcggttggggctccggagagctccgagagggcgggatgggcagaggacctcttgtaggagacctgatggcgcgagggaggc

SEQ ID NO: 1354 - DNA, 495 bp, Artificial Sequence
  Synthetic Template Oligonucleotide for TCRB Locus
gccttgccagcccgctcagacctcttggtgtctactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtgtctacgtcgacagatacgcagtattttggcccaggcacccggctgacagtgctcggtaagcgggggctcccgctgaagccccggaactggggagggggcgccccgggacgcacctcttggtgtctacctgatggcgcgagggaggc

SEQ ID NO: 1355 - DNA, 495 bp, Artificial Sequence
  Synthetic Template Oligonucleotide for TCRB Locus
gccttgccagcccgctcagacctcttggtacagtgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtacagtggtcgacaaaacattcagtacttcggcgccgggacccggctctcagtgctgggtaagctggggccgccgggggaccggggacgagactgcgctcgggtttttgtgcgacctcttggtacagtgctgatggcgcgagggaggc

SEQ ID NO: 1356 - DNA, 495 bp, Artificial Sequence
  Synthetic Template Oligonucleotide for TCRB Locus
gccttgccagcccgctcagacctcttgggatcatctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgggatcatcgtcgacgagacccagtacttcgggccaggcacgcggctcctggtgctcggtgagcgcgggctgctggggcgcgggcgcgggcggcttgggtctggtttttgcggggacctcttgggatcatcctgatggcgcgagggaggc

SEQ ID NO: 1357 - DNA, 495 bp, Artificial Sequence
  Synthetic Template Oligonucleotide for TCRB Locus
gccttgccagcccgctcagacctcttgtattggcgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgtattggcggtcgacgggccaacgtcctgactttcggggccggcagcaggctgaccgtgctgggtgagttttcgcgggaccacccgggcggcgggattcaggtggaaggcggcggacctcttgtattggcgctgatggcgcgagggaggc

SEQ ID NO: 1358 - DNA, 495 bp, Artificial Sequence
  Synthetic Template Oligonucleotide for TCRB Locus
gccttgccagcccgctcagacctcttgaggcttgatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgaggcttgagtcgacacgagcagtacttcgggccgggcaccaggctcacggtcacaggtgagattcgggcgtctccccaccttccagcccctcggtccccggagtcggagggtggacctcttgaggcttgactgatggcgcgagggaggc

SEQ ID NO: 1359 - DNA, 495 bp, Artificial Sequence
  Synthetic Template Oligonucleotide for TCRB Locus
gccttgccagcccgctcagctgattctgacactctcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgacactctgtcgacactgaagctttctttggacaaggcaccagactcacagttgtaggtaagacatttttcaggttcttttgcagatccgtcacagggaaaagtgggtccacagctgattctgacactctctgatggcgcgagggaggc

SEQ ID NO: 1360 - DNA, 495 bp, Artificial Sequence
  Synthetic Template Oligonucleotide for TCRB Locus
gccttgccagcccgctcagctgattctttcggaaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctttcggaacgtcgactatggctacaccttcggttcggggaccaggttaaccgttgtaggtaaggctgggggtctctaggaggggtgcgatgagggaggactctgtcctgggaaatctgattctttcggaacctgatggcgcgagggaggc

SEQ ID NO: 1361 - DNA, 495 bp, Artificial Sequence
  Synthetic Template Oligonucleotide for TCRB Locus
gccttgccagcccgctcagctgattctaagtaacgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctaagtaacggtcgacgaaacaccatatattttggagagggaagttggctcactgttgtaggtgagtaagtcaaggctggacagctgggaacttgcaaaaaggggctggaatccagctgattctaagtaacgctgatggcgcgagggaggc

SEQ ID NO: 1362 - DNA, 495 bp, Artificial Sequence
  Synthetic Template Oligonucleotide for TCRB Locus
gccttgccagcccgctcagctgattctgtctcctacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtctcctagtcgacaatgaaaaactgttttttggcagtggaacccagctctctgtcttgggtatgtaaaagacttctttcgggatagtgtatcataaggtcggagttccaggagctgattctgtctcctactgatggcgcgagggaggc

SEQ ID NO: 1363 - DNA, 495 bp, Artificial Sequence
  Synthetic Template Oligonucleotide for TCRB Locus
gccttgccagcccgctcagctgattctagagtgtccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctagagtgtcgtcgacatcagccccagcattttggtgatgggactcgactctccatcctaggtaagttgcagaatcagggtggtatggccattgtcccttgaaggcagagttctctctgattctagagtgtcctgatggcgcgagggaggc

SEQ ID NO: 1364 - DNA, 495 bp, Artificial Sequence
  Synthetic Template Oligonucleotide for TCRB Locus
gccttgccagcccgctcagctgattctgttccgaacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgttccgaagtcgacataattcacccctccactttgggaacgggaccaggctcactgtgacaggtatgggggctccactcttgactcgggggtgcctgggtttgactgcaatgatctgattctgttccgaactgatggcgcgagggaggc

SEQ ID NO: 1365 - DNA, 495 bp, Artificial Sequence
  Synthetic Template Oligonucleotide for TCRB Locus
gccttgccagcccgctcagctgattctcgttacttcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctcgttacttgtcgacacaatgagcagttcttcgggccagggacacggctcaccgtgctaggtaagaagggggctccaggtgggagagagggtgagcagcccagcctgcacgacccctgattctcgttacttctgatggcgcgagggaggc

SEQ ID NO: 1366 - DNA, 495 bp, Artificial Sequence
  Synthetic Template Oligonucleotide for TCRB Locus
gccttgccagcccgctcagctgattcttaggagaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattcttaggagacgtcgacaccggggagctgttttttggagaaggctctaggctgaccgtactgggtaaggaggcggttggggctccggagagctccgagagggcgggatgggcagaggctgattcttaggagacctgatggcgcgagggaggc

SEQ ID NO: 1367 - DNA, 495 bp, Artificial Sequence
  Synthetic Template Oligonucleotide for TCRB Locus
gccttgccagcccgctcagctgattctgtgtctaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtgtctacgtcgacagatacgcagtattttggcccaggcacccggctgacagtgctcggtaagcgggggctcccgctgaagccccggaactggggagggggcgccccgggacgcctgattctgtgtctacctgatggcgcgagggaggc

SEQ ID NO: 1368 - DNA, 495 bp, Artificial Sequence
  Synthetic Template Oligonucleotide for TCRB Locus
gccttgccagcccgctcagctgattctgtacagtgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtacagtggtcgacaaaacattcagtacttcggcgccgggacccggctctcagtgctgggtaagctggggccgccgggggaccggggacgagactgcgctcgggtttttgtgcgctgattctgtacagtgctgatggcgcgagggaggc

SEQ ID NO: 1369 - DNA, 495 bp, Artificial Sequence
  Synthetic Template Oligonucleotide for TCRB Locus
gccttgccagcccgctcagctgattctggatcatccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctggatcatcgtcgacgagacccagtacttcgggccaggcacgcggctcctggtgctcggtgagcgcgggctgctggggcgcgggcgcgggcggcttgggtctggtttttgcggggctgattctggatcatcctgatggcgcgagggaggc

SEQ ID NO: 1370 - DNA, 495 bp, Artificial Sequence
  Synthetic Template Oligonucleotide for TCRB Locus
gccttgccagcccgctcagctgattcttattggcgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattcttattggcggtcgacgggccaacgtcctgactttcggggccggcagcaggctgaccgtgctgggtgagttttcgcgggaccacccgggcggcgggattcaggtggaaggcggcggctgattcttattggcgctgatggcgcgagggaggc

SEQ ID NO: 1371 - DNA, 495 bp, Artificial Sequence
  Synthetic Template Oligonucleotide for TCRB Locus
gccttgccagcccgctcagctgattctaggcttgacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctaggcttgagtcgacacgagcagtacttcgggccgggcaccaggctcacggtcacaggtgagattcgggcgtctccccaccttccagcccctcggtccccggagtcggagggtggctgattctaggcttgactgatggcgcgagggaggc

SEQ ID NO: 1372 - DNA, 495 bp, Artificial Sequence
  Synthetic Template Oligonucleotide for TCRB Locus
gccttgccagcccgctcagggtcaactgacactcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgacactctgtcgacactgaagctttctttggacaaggcaccagactcacagttgtaggtaagacatttttcaggttcttttgcagatccgtcacagggaaaagtgggtccacagggtcaactgacactctctgatggcgcgagggaggc

SEQ ID NO: 1373 - DNA, 495 bp, Artificial Sequence
  Synthetic Template Oligonucleotide for TCRB Locus
gccttgccagcccgctcagggtcaactttcggaactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactttcggaacgtcgactatggctacaccttcggttcggggaccaggttaaccgttgtaggtaaggctgggggtctctaggaggggtgcgatgagggaggactctgtcctgggaaatggtcaactttcggaacctgatggcgcgagggaggc

SEQ ID NO: 1374 - DNA, 495 bp, Artificial Sequence
  Synthetic Template Oligonucleotide for TCRB Locus
gccttgccagcccgctcagggtcaactaagtaacgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactaagtaacggtcgacgaaacaccatatattttggagagggaagttggctcactgttgtaggtgagtaagtcaaggctggacagctgggaacttgcaaaaaggggctggaatccagggtcaactaagtaacgctgatggcgcgagggaggc

SEQ ID NO: 1375 - DNA, 495 bp, Artificial Sequence
  Synthetic Template Oligonucleotide for TCRB Locus
gccttgccagcccgctcagggtcaactgtctcctatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtctcctagtcgacaatgaaaaactgttttttggcagtggaacccagctctctgtcttgggtatgtaaaagacttctttcgggatagtgtatcataaggtcggagttccaggagggtcaactgtctcctactgatggcgcgagggaggc

SEQ ID NO: 1376 - DNA, 495 bp, Artificial Sequence
  Synthetic Template Oligonucleotide for TCRB Locus
gccttgccagcccgctcagggtcaactagagtgtctttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactagagtgtcgtcgacatcagccccagcattttggtgatgggactcgactctccatcctaggtaagttgcagaatcagggtggtatggccattgtcccttgaaggcagagttctctggtcaactagagtgtcctgatggcgcgagggaggc

SEQ ID NO: 1377 - DNA, 495 bp, Artificial Sequence
  Synthetic Template Oligonucleotide for TCRB Locus
gccttgccagcccgctcagggtcaactgttccgaatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgttccgaagtcgacataattcacccctccactttgggaacgggaccaggctcactgtgacaggtatgggggctccactcttgactcgggggtgcctgggtttgactgcaatgatggtcaactgttccgaactgatggcgcgagggaggc

SEQ ID NO: 1378 - DNA, 495 bp, Artificial Sequence
  Synthetic Template Oligonucleotide for TCRB Locus
gccttgccagcccgctcagggtcaactcgttactttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactcgttacttgtcgacacaatgagcagttcttcgggccagggacacggctcaccgtgctaggtaagaagggggctccaggtgggagagagggtgagcagcccagcctgcacgacccggtcaactcgttacttctgatggcgcgagggaggc

SEQ ID NO: 1379 - DNA, 495 bp, Artificial Sequence
  Synthetic Template Oligonucleotide for TCRB Locus
gccttgccagcccgctcagggtcaacttaggagactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaacttaggagacgtcgacaccggggagctgttttttggagaaggctctaggctgaccgtactgggtaaggaggcggttggggctccggagagctccgagagggcgggatgggcagaggggtcaacttaggagacctgatggcgcgagggaggc

SEQ ID NO: 1380 - DNA, 495 bp, Artificial Sequence
  Synthetic Template Oligonucleotide for TCRB Locus
gccttgccagcccgctcagggtcaactgtgtctactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtgtctacgtcgacagatacgcagtattttggcccaggcacccggctgacagtgctcggtaagcgggggctcccgctgaagccccggaactggggagggggcgccccgggacgcggtcaactgtgtctacctgatggcgcgagggaggc

SEQ ID NO: 1381 - DNA, 495 bp, Artificial Sequence
  Synthetic Template Oligonucleotide for TCRB Locus
gccttgccagcccgctcagggtcaactgtacagtgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtacagtggtcgacaaaacattcagtacttcggcgccgggacccggctctcagtgctgggtaagctggggccgccgggggaccggggacgagactgcgctcgggtttttgtgcgggtcaactgtacagtgctgatggcgcgagggaggc

SEQ ID NO: 1382 - DNA, 495 bp, Artificial Sequence
  Synthetic Template Oligonucleotide for TCRB Locus
gccttgccagcccgctcagggtcaactggatcatctttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactggatcatcgtcgacgagacccagtacttcgggccaggcacgcggctcctggtgctcggtgagcgcgggctgctggggcgcgggcgcgggcggcttgggtctggtttttgcggggggtcaactggatcatcctgatggcgcgagggaggc

SEQ ID NO: 1383 - DNA, 495 bp, Artificial Sequence
  Synthetic Template Oligonucleotide for TCRB Locus
gccttgccagcccgctcagggtcaacttattggcgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaacttattggcggtcgacgggccaacgtcctgactttcggggccggcagcaggctgaccgtgctgggtgagttttcgcgggaccacccgggcggcgggattcaggtggaaggcggcggggtcaacttattggcgctgatggcgcgagggaggc

SEQ ID NO: 1384 - DNA, 495 bp, Artificial Sequence
  Synthetic Template Oligonucleotide for TCRB Locus
gccttgccagcccgctcagggtcaactaggcttgatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactaggcttgagtcgacacgagcagtacttcgggccgggcaccaggctcacggtcacaggtgagattcgggcgtctccccaccttccagcccctcggtccccggagtcggagggtggggtcaactaggcttgactgatggcgcgagggaggc

SEQ ID NO: 1385 - DNA, 495 bp, Artificial Sequence
  Synthetic Template Oligonucleotide for TCRB Locus
gccttgccagcccgctcaggcataactgacactctttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgacactctgtcgacactgaagctttctttggacaaggcaccagactcacagttgtaggtaagacatttttcaggttcttttgcagatccgtcacagggaaaagtgggtccacaggcataactgacactctctgatggcgcgagggaggc

SEQ ID NO: 1386 - DNA, 495 bp, Artificial Sequence
  Synthetic Template Oligonucleotide for TCRB Locus
gccttgccagcccgctcaggcataactttcggaacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactttcggaacgtcgactatggctacaccttcggttcggggaccaggttaaccgttgtaggtaaggctgggggtctctaggaggggtgcgatgagggaggactctgtcctgggaaatgcataactttcggaacctgatggcgcgagggaggc

SEQ ID NO: 1387 - DNA, 495 bp, Artificial Sequence
  Synthetic Template Oligonucleotide for TCRB Locus
gccttgccagcccgctcaggcataactaagtaacgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactaagtaacggtcgacgaaacaccatatattttggagagggaagttggctcactgttgtaggtgagtaagtcaaggctggacagctgggaacttgcaaaaaggggctggaatccaggcataactaagtaacgctgatggcgcgagggaggc

SEQ ID NO: 1388 - DNA, 495 bp, Artificial Sequence
  Synthetic Template Oligonucleotide for TCRB Locus
gccttgccagcccgctcaggcataactgtctcctattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtctcctagtcgacaatgaaaaactgttttttggcagtggaacccagctctctgtcttgggtatgtaaaagacttctttcgggatagtgtatcataaggtcggagttccaggaggcataactgtctcctactgatggcgcgagggaggc

SEQ ID NO: 1389 - DNA, 495 bp, Artificial Sequence
  Synthetic Template Oligonucleotide for TCRB Locus
gccttgccagcccgctcaggcataactagagtgtcttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactagagtgtcgtcgacatcagccccagcattttggtgatgggactcgactctccatcctaggtaagttgcagaatcagggtggtatggccattgtcccttgaaggcagagttctctgcataactagagtgtcctgatggcgcgagggaggc

SEQ ID NO: 1390 - DNA, 495 bp, Artificial Sequence
  Synthetic Template Oligonucleotide for TCRB Locus
gccttgccagcccgctcaggcataactgttccgaattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgttccgaagtcgacataattcacccctccactttgggaacgggaccaggctcactgtgacaggtatgggggctccactcttgactcgggggtgcctgggtttgactgcaatgatgcataactgttccgaactgatggcgcgagggaggc

SEQ ID NO: 1391 - DNA, 495 bp, Artificial Sequence
  Synthetic Template Oligonucleotide for TCRB Locus
gccttgccagcccgctcaggcataactcgttacttttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactcgttacttgtcgacacaatgagcagttcttcgggccagggacacggctcaccgtgctaggtaagaagggggctccaggtgggagagagggtgagcagcccagcctgcacgacccgcataactcgttacttctgatggcgcgagggaggc

SEQ ID NO: 1392 - DNA, 495 bp, Artificial Sequence
  Synthetic Template Oligonucleotide for TCRB Locus
gccttgccagcccgctcaggcataacttaggagacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataacttaggagacgtcgacaccggggagctgttttttggagaaggctctaggctgaccgtactgggtaaggaggcggttggggctccggagagctccgagagggcgggatgggcagagggcataacttaggagacctgatggcgcgagggaggc

SEQ ID NO: 1393 - DNA, 495 bp, Artificial Sequence
  Synthetic Template Oligonucleotide for TCRB Locus
gccttgccagcccgctcaggcataactgtgtctacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtgtctacgtcgacagatacgcagtattttggcccaggcacccggctgacagtgctcggtaagcgggggctcccgctgaagccccggaactggggagggggcgccccgggacgcgcataactgtgtctacctgatggcgcgagggaggc

SEQ ID NO: 1394 - DNA, 495 bp, Artificial Sequence
  Synthetic Template Oligonucleotide for TCRB Locus
gccttgccagcccgctcaggcataactgtacagtgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtacagtggtcgacaaaacattcagtacttcggcgccgggacccggctctcagtgctgggtaagctggggccgccgggggaccggggacgagactgcgctcgggtttttgtgcggcataactgtacagtgctgatggcgcgagggaggc

SEQ ID NO: 1395 - DNA, 495 bp, Artificial Sequence
  Synthetic Template Oligonucleotide for TCRB Locus
gccttgccagcccgctcaggcataactggatcatcttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactggatcatcgtcgacgagacccagtacttcgggccaggcacgcggctcctggtgctcggtgagcgcgggctgctggggcgcgggcgcgggcggcttgggtctggtttttgcgggggcataactggatcatcctgatggcgcgagggaggc

SEQ ID NO: 1396 - DNA, 495 bp, Artificial Sequence
  Synthetic Template Oligonucleotide for TCRB Locus
gccttgccagcccgctcaggcataacttattggcgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataacttattggcggtcgacgggccaacgtcctgactttcggggccggcagcaggctgaccgtgctgggtgagttttcgcgggaccacccgggcggcgggattcaggtggaaggcggcgggcataacttattggcgctgatggcgcgagggaggc

SEQ ID NO: 1397 - DNA, 495 bp, Artificial Sequence
  Synthetic Template Oligonucleotide for TCRB Locus
gccttgccagcccgctcaggcataactaggcttgattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactaggcttgagtcgacacgagcagtacttcgggccgggcaccaggctcacggtcacaggtgagattcgggcgtctccccaccttccagcccctcggtccccggagtcggagggtgggcataactaggcttgactgatggcgcgagggaggc

SEQ ID NO: 1398 - DNA, 495 bp, Artificial Sequence
  Synthetic Template Oligonucleotide for TCRB Locus
gccttgccagcccgctcagatatgctggacactcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggacactctgtcgacactgaagctttctttggacaaggcaccagactcacagttgtaggtaagacatttttcaggttcttttgcagatccgtcacagggaaaagtgggtccacagatatgctggacactctctgatggcgcgagggaggc

SEQ ID NO: 1399 - DNA, 495 bp, Artificial Sequence
  Synthetic Template Oligonucleotide for TCRB Locus
gccttgccagcccgctcagatatgctgttcggaactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgttcggaacgtcgactatggctacaccttcggttcggggaccaggttaaccgttgtaggtaaggctgggggtctctaggaggggtgcgatgagggaggactctgtcctgggaaatatatgctgttcggaacctgatggcgcgagggaggc

SEQ ID NO: 1400 - DNA, 495 bp, Artificial Sequence
  Synthetic Template Oligonucleotide for TCRB Locus
gccttgccagcccgctcagatatgctgaagtaacgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgaagtaacggtcgacgaaacaccatatattttggagagggaagttggctcactgttgtaggtgagtaagtcaaggctggacagctgggaacttgcaaaaaggggctggaatccagatatgctgaagtaacgctgatggcgcgagggaggc

SEQ ID NO: 1401 - DNA, 495 bp, Artificial Sequence
  Synthetic Template Oligonucleotide for TCRB Locus
gccttgccagcccgctcagatatgctggtctcctatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtctcctagtcgacaatgaaaaactgttttttggcagtggaacccagctctctgtcttgggtatgtaaaagacttctttcgggatagtgtatcataaggtcggagttccaggagatatgctggtctcctactgatggcgcgagggaggc

SEQ ID NO: 1402 - DNA, 495 bp, Artificial Sequence
  Synthetic Template Oligonucleotide for TCRB Locus
gccttgccagcccgctcagatatgctgagagtgtctcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgagagtgtcgtcgacatcagccccagcattttggtgatgggactcgactctccatcctaggtaagttgcagaatcagggtggtatggccattgtcccttgaaggcagagttctctatatgctgagagtgtcctgatggcgcgagggaggc

SEQ ID NO: 1403 - DNA, 495 bp, Artificial Sequence
  Synthetic Template Oligonucleotide for TCRB Locus
gccttgccagcccgctcagatatgctggttccgaatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggttccgaagtcgacataattcacccctccactttgggaacgggaccaggctcactgtgacaggtatgggggctccactcttgactcgggggtgcctgggtttgactgcaatgatatatgctggttccgaactgatggcgcgagggaggc

SEQ ID NO: 1404 - DNA, 495 bp, Artificial Sequence
  Synthetic Template Oligonucleotide for TCRB Locus
gccttgccagcccgctcagatatgctgcgttactttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgcgttacttgtcgacacaatgagcagttcttcgggccagggacacggctcaccgtgctaggtaagaagggggctccaggtgggagagagggtgagcagcccagcctgcacgacccatatgctgcgttacttctgatggcgcgagggaggc

SEQ ID NO: 1405 - DNA, 495 bp, Artificial Sequence
  Synthetic Template Oligonucleotide for TCRB Locus
gccttgccagcccgctcagatatgctgtaggagactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgtaggagacgtcgacaccggggagctgttttttggagaaggctctaggctgaccgtactgggtaaggaggcggttggggctccggagagctccgagagggcgggatgggcagaggatatgctgtaggagacctgatggcgcgagggaggc

SEQ ID NO: 1406 - DNA, 495 bp, Artificial Sequence
  Synthetic Template Oligonucleotide for TCRB Locus
gccttgccagcccgctcagatatgctggtgtctactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtgtctacgtcgacagatacgcagtattttggcccaggcacccggctgacagtgctcggtaagcgggggctcccgctgaagccccggaactggggagggggcgccccgggacgcatatgctggtgtctacctgatggcgcgagggaggc

SEQ ID NO: 1407 - DNA, 495 bp, Artificial Sequence
  Synthetic Template Oligonucleotide for TCRB Locus
gccttgccagcccgctcagatatgctggtacagtgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtacagtggtcgacaaaacattcagtacttcggcgccgggacccggctctcagtgctgggtaagctggggccgccgggggaccggggacgagactgcgctcgggtttttgtgcgatatgctggtacagtgctgatggcgcgagggaggc

SEQ ID NO: 1408 - DNA, 495 bp, Artificial Sequence
  Synthetic Template Oligonucleotide for TCRB Locus
gccttgccagcccgctcagatatgctgggatcatctcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgggatcatcgtcgacgagacccagtacttcgggccaggcacgcggctcctggtgctcggtgagcgcgggctgctggggcgcgggcgcgggcggcttgggtctggtttttgcggggatatgctgggatcatcctgatggcgcgagggaggc

SEQ ID NO: 1409 - DNA, 495 bp, Artificial Sequence
  Synthetic Template Oligonucleotide for TCRB Locus
gccttgccagcccgctcagatatgctgtattggcgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgtattggcggtcgacgggccaacgtcctgactttcggggccggcagcaggctgaccgtgctgggtgagttttcgcgggaccacccgggcggcgggattcaggtggaaggcggcggatatgctgtattggcgctgatggcgcgagggaggc

SEQ ID NO: 1410 - DNA, 495 bp, Artificial Sequence
  Synthetic Template Oligonucleotide for TCRB Locus
gccttgccagcccgctcagatatgctgaggcttgatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgaggcttgagtcgacacgagcagtacttcgggccgggcaccaggctcacggtcacaggtgagattcgggcgtctccccaccttccagcccctcggtccccggagtcggagggtggatatgctgaggcttgactgatggcgcgagggaggc

SEQ ID NO: 1411 - DNA, 495 bp, Artificial Sequence
  Synthetic Template Oligonucleotide for TCRB Locus
gccttgccagcccgctcagaatcctgcgacactcttttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgacactctgtcgacactgaagctttctttggacaaggcaccagactcacagttgtaggtaagacatttttcaggttcttttgcagatccgtcacagggaaaagtgggtccacagaatcctgcgacactctctgatggcgcgagggaggc

SEQ ID NO: 1412 - DNA, 495 bp, Artificial Sequence
  Synthetic Template Oligonucleotide for TCRB Locus
gccttgccagcccgctcagaatcctgcttcggaactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcttcggaacgtcgactatggctacaccttcggttcggggaccaggttaaccgttgtaggtaaggctgggggtctctaggaggggtgcgatgagggaggactctgtcctgggaaataatcctgcttcggaacctgatggcgcgagggaggc

SEQ ID NO: 1413 - DNA, 495 bp, Artificial Sequence
  Synthetic Template Oligonucleotide for TCRB Locus
gccttgccagcccgctcagaatcctgcaagtaacgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcaagtaacggtcgacgaaacaccatatattttggagagggaagttggctcactgttgtaggtgagtaagtcaaggctggacagctgggaacttgcaaaaaggggctggaatccagaatcctgcaagtaacgctgatggcgcgagggaggc

SEQ ID NO: 1414 - DNA, 495 bp, Artificial Sequence
  Synthetic Template Oligonucleotide for TCRB Locus
gccttgccagcccgctcagaatcctgcgtctcctatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtctcctagtcgacaatgaaaaactgttttttggcagtggaacccagctctctgtcttgggtatgtaaaagacttctttcgggatagtgtatcataaggtcggagttccaggagaatcctgcgtctcctactgatggcgcgagggaggc

SEQ ID NO: 1415 - DNA, 495 bp, Artificial Sequence
  Synthetic Template Oligonucleotide for TCRB Locus
gccttgccagcccgctcagaatcctgcagagtgtctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcagagtgtcgtcgacatcagccccagcattttggtgatgggactcgactctccatcctaggtaagttgcagaatcagggtggtatggccattgtcccttgaaggcagagttctctaatcctgcagagtgtcctgatggcgcgagggaggc

SEQ ID NO: 1416 - DNA, 495 bp, Artificial Sequence
  Synthetic Template Oligonucleotide for TCRB Locus
gccttgccagcccgctcagaatcctgcgttccgaatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgttccgaagtcgacataattcacccctccactttgggaacgggaccaggctcactgtgacaggtatgggggctccactcttgactcgggggtgcctgggtttgactgcaatgataatcctgcgttccgaactgatggcgcgagggaggc

SEQ ID NO: 1417 - DNA, 495 bp, Artificial Sequence
  Synthetic Template Oligonucleotide for TCRB Locus
gccttgccagcccgctcagaatcctgccgttactttttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgccgttacttgtcgacacaatgagcagttcttcgggccagggacacggctcaccgtgctaggtaagaagggggctccaggtgggagagagggtgagcagcccagcctgcacgacccaatcctgccgttacttctgatggcgcgagggaggc

SEQ ID NO: 1418 - DNA, 495 bp, Artificial Sequence
  Synthetic Template Oligonucleotide for TCRB Locus
gccttgccagcccgctcagaatcctgctaggagactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgctaggagacgtcgacaccggggagctgttttttggagaaggctctaggctgaccgtactgggtaaggaggcggttggggctccggagagctccgagagggcgggatgggcagaggaatcctgctaggagacctgatggcgcgagggaggc

SEQ ID NO: 1419 - DNA, 495 bp, Artificial Sequence
  Synthetic Template Oligonucleotide for TCRB Locus
gccttgccagcccgctcagaatcctgcgtgtctactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtgtctacgtcgacagatacgcagtattttggcccaggcacccggctgacagtgctcggtaagcgggggctcccgctgaagccccggaactggggagggggcgccccgggacgcaatcctgcgtgtctacctgatggcgcgagggaggc

SEQ ID NO: 1420 - DNA, 495 bp, Artificial Sequence
  Synthetic Template Oligonucleotide for TCRB Locus
gccttgccagcccgctcagaatcctgcgtacagtgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtacagtggtcgacaaaacattcagtacttcggcgccgggacccggctctcagtgctgggtaagctggggccgccgggggaccggggacgagactgcgctcgggtttttgtgcgaatcctgcgtacagtgctgatggcgcgagggaggc

SEQ ID NO: 1421 - DNA, 495 bp, Artificial Sequence
  Synthetic Template Oligonucleotide for TCRB Locus
gccttgccagcccgctcagaatcctgcggatcatctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcggatcatcgtcgacgagacccagtacttcgggccaggcacgcggctcctggtgctcggtgagcgcgggctgctggggcgcgggcgcgggcggcttgggtctggtttttgcggggaatcctgcggatcatcctgatggcgcgagggaggc

SEQ ID NO: 1422 - DNA, 495 bp, Artificial Sequence
  Synthetic Template Oligonucleotide for TCRB Locus
gccttgccagcccgctcagaatcctgctattggcgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgctattggcggtcgacgggccaacgtcctgactttcggggccggcagcaggctgaccgtgctgggtgagttttcgcgggaccacccgggcggcgggattcaggtggaaggcggcggaatcctgctattggcgctgatggcgcgagggaggc

SEQ ID NO: 1423 - DNA, 495 bp, Artificial Sequence
  Synthetic Template Oligonucleotide for TCRB Locus
gccttgccagcccgctcagaatcctgcaggcttgatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcaggcttgagtcgacacgagcagtacttcgggccgggcaccaggctcacggtcacaggtgagattcgggcgtctccccaccttccagcccctcggtccccggagtcggagggtggaatcctgcaggcttgactgatggcgcgagggaggc

SEQ ID NO: 1424 - DNA, 495 bp, Artificial Sequence
  Synthetic Template Oligonucleotide for TCRB Locus
gccttgccagcccgctcagtgagacctgacactctctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgacactctgtcgacactgaagctttctttggacaaggcaccagactcacagttgtaggtaagacatttttcaggttcttttgcagatccgtcacagggaaaagtgggtccacagtgagacctgacactctctgatggcgcgagggaggc

SEQ ID NO: 1425 - DNA, 495 bp, Artificial Sequence
  Synthetic Template Oligonucleotide for TCRB Locus
gccttgccagcccgctcagtgagacctttcggaacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctttcggaacgtcgactatggctacaccttcggttcggggaccaggttaaccgttgtaggtaaggctgggggtctctaggaggggtgcgatgagggaggactctgtcctgggaaattgagacctttcggaacctgatggcgcgagggaggc

SEQ ID NO: 1426 - DNA, 495 bp, Artificial Sequence
  Synthetic Template Oligonucleotide for TCRB Locus
gccttgccagcccgctcagtgagacctaagtaacgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctaagtaacggtcgacgaaacaccatatattttggagagggaagttggctcactgttgtaggtgagtaagtcaaggctggacagctgggaacttgcaaaaaggggctggaatccagtgagacctaagtaacgctgatggcgcgagggaggc

SEQ ID NO: 1427 - DNA, 495 bp, Artificial Sequence
  Synthetic Template Oligonucleotide for TCRB Locus
gccttgccagcccgctcagtgagacctgtctcctactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtctcctagtcgacaatgaaaaactgttttttggcagtggaacccagctctctgtcttgggtatgtaaaagacttctttcgggatagtgtatcataaggtcggagttccaggagtgagacctgtctcctactgatggcgcgagggaggc

SEQ ID NO: 1428 - DNA, 495 bp, Artificial Sequence
  Synthetic Template Oligonucleotide for TCRB Locus
gccttgccagcccgctcagtgagacctagagtgtcctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctagagtgtcgtcgacatcagccccagcattttggtgatgggactcgactctccatcctaggtaagttgcagaatcagggtggtatggccattgtcccttgaaggcagagttctcttgagacctagagtgtcctgatggcgcgagggaggc

SEQ ID NO: 1429 - DNA, 495 bp, Artificial Sequence
  Synthetic Template Oligonucleotide for TCRB Locus
gccttgccagcccgctcagtgagacctgttccgaactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgttccgaagtcgacataattcacccctccactttgggaacgggaccaggctcactgtgacaggtatgggggctccactcttgactcgggggtgcctgggtttgactgcaatgattgagacctgttccgaactgatggcgcgagggaggc

SEQ ID NO: 1430 - DNA, 495 bp, Artificial Sequence
  Synthetic Template Oligonucleotide for TCRB Locus
gccttgccagcccgctcagtgagacctcgttacttctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctcgttacttgtcgacacaatgagcagttcttcgggccagggacacggctcaccgtgctaggtaagaagggggctccaggtgggagagagggtgagcagcccagcctgcacgaccctgagacctcgttacttctgatggcgcgagggaggc

SEQ ID NO: 1431 - DNA, 495 bp, Artificial Sequence
  Synthetic Template Oligonucleotide for TCRB Locus
gccttgccagcccgctcagtgagaccttaggagacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagaccttaggagacgtcgacaccggggagctgttttttggagaaggctctaggctgaccgtactgggtaaggaggcggttggggctccggagagctccgagagggcgggatgggcagaggtgagaccttaggagacctgatggcgcgagggaggc

SEQ ID NO: 1432 - DNA, 495 bp, Artificial Sequence
  Synthetic Template Oligonucleotide for TCRB Locus
gccttgccagcccgctcagtgagacctgtgtctacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtgtctacgtcgacagatacgcagtattttggcccaggcacccggctgacagtgctcggtaagcgggggctcccgctgaagccccggaactggggagggggcgccccgggacgctgagacctgtgtctacctgatggcgcgagggaggc

SEQ ID NO: 1433 - DNA, 495 bp, Artificial Sequence
  Synthetic Template Oligonucleotide for TCRB Locus
gccttgccagcccgctcagtgagacctgtacagtgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtacagtggtcgacaaaacattcagtacttcggcgccgggacccggctctcagtgctgggtaagctggggccgccgggggaccggggacgagactgcgctcgggtttttgtgcgtgagacctgtacagtgctgatggcgcgagggaggc

SEQ ID NO: 1434 - DNA, 495 bp, Artificial Sequence
  Synthetic Template Oligonucleotide for TCRB Locus
gccttgccagcccgctcagtgagacctggatcatcctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctggatcatcgtcgacgagacccagtacttcgggccaggcacgcggctcctggtgctcggtgagcgcgggctgctggggcgcgggcgcgggcggcttgggtctggtttttgcggggtgagacctggatcatcctgatggcgcgagggaggc

SEQ ID NO: 1435 - DNA, 495 bp, Artificial Sequence
  Synthetic Template Oligonucleotide for TCRB Locus
gccttgccagcccgctcagtgagaccttattggcgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagaccttattggcggtcgacgggccaacgtcctgactttcggggccggcagcaggctgaccgtgctgggtgagttttcgcgggaccacccgggcggcgggattcaggtggaaggcggcggtgagaccttattggcgctgatggcgcgagggaggc

SEQ ID NO: 1436 - DNA, 495 bp, Artificial Sequence
  Synthetic Template Oligonucleotide for TCRB Locus
gccttgccagcccgctcagtgagacctaggcttgactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctaggcttgagtcgacacgagcagtacttcgggccgggcaccaggctcacggtcacaggtgagattcgggcgtctccccaccttccagcccctcggtccccggagtcggagggtggtgagacctaggcttgactgatggcgcgagggaggc

SEQ ID NO: 1437 - DNA, 495 bp, Artificial Sequence
  Synthetic Template Oligonucleotide for TCRB Locus
gccttgccagcccgctcaggaatggacgacactctttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgacactctgtcgacactgaagctttctttggacaaggcaccagactcacagttgtaggtaagacatttttcaggttcttttgcagatccgtcacagggaaaagtgggtccacaggaatggacgacactctctgatggcgcgagggaggc

SEQ ID NO: 1438 - DNA, 495 bp, Artificial Sequence
  Synthetic Template Oligonucleotide for TCRB Locus
gccttgccagcccgctcaggaatggacttcggaacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacttcggaacgtcgactatggctacaccttcggttcggggaccaggttaaccgttgtaggtaaggctgggggtctctaggaggggtgcgatgagggaggactctgtcctgggaaatgaatggacttcggaacctgatggcgcgagggaggc

SEQ ID NO: 1439 - DNA, 495 bp, Artificial Sequence
  Synthetic Template Oligonucleotide for TCRB Locus
gccttgccagcccgctcaggaatggacaagtaacgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacaagtaacggtcgacgaaacaccatatattttggagagggaagttggctcactgttgtaggtgagtaagtcaaggctggacagctgggaacttgcaaaaaggggctggaatccaggaatggacaagtaacgctgatggcgcgagggaggc

SEQ ID NO: 1440 - DNA, 495 bp, Artificial Sequence
  Synthetic Template Oligonucleotide for TCRB Locus
gccttgccagcccgctcaggaatggacgtctcctattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtctcctagtcgacaatgaaaaactgttttttggcagtggaacccagctctctgtcttgggtatgtaaaagacttctttcgggatagtgtatcataaggtcggagttccaggaggaatggacgtctcctactgatggcgcgagggaggc

SEQ ID NO: 1441 - DNA, 495 bp, Artificial Sequence
  Synthetic Template Oligonucleotide for TCRB Locus
gccttgccagcccgctcaggaatggacagagtgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacagagtgtcgtcgacatcagccccagcattttggtgatgggactcgactctccatcctaggtaagttgcagaatcagggtggtatggccattgtcccttgaaggcagagttctctgaatggacagagtgtcctgatggcgcgagggaggc

SEQ ID NO: 1442 - DNA, 495 bp, Artificial Sequence
  Synthetic Template Oligonucleotide for TCRB Locus
gccttgccagcccgctcaggaatggacgttccgaattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgttccgaagtcgacataattcacccctccactttgggaacgggaccaggctcactgtgacaggtatgggggctccactcttgactcgggggtgcctgggtttgactgcaatgatgaatggacgttccgaactgatggcgcgagggaggc

SEQ ID NO: 1443 - DNA, 495 bp, Artificial Sequence
  Synthetic Template Oligonucleotide for TCRB Locus
gccttgccagcccgctcaggaatggaccgttacttttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggaccgttacttgtcgacacaatgagcagttcttcgggccagggacacggctcaccgtgctaggtaagaagggggctccaggtgggagagagggtgagcagcccagcctgcacgacccgaatggaccgttacttctgatggcgcgagggaggc

SEQ ID NO: 1444 - DNA, 495 bp, Artificial Sequence
  Synthetic Template Oligonucleotide for TCRB Locus
gccttgccagcccgctcaggaatggactaggagacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggactaggagacgtcgacaccggggagctgttttttggagaaggctctaggctgaccgtactgggtaaggaggcggttggggctccggagagctccgagagggcgggatgggcagagggaatggactaggagacctgatggcgcgagggaggc

SEQ ID NO: 1445 - DNA, 495 bp, Artificial Sequence
  Synthetic Template Oligonucleotide for TCRB Locus
gccttgccagcccgctcaggaatggacgtgtctacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtgtctacgtcgacagatacgcagtattttggcccaggcacccggctgacagtgctcggtaagcgggggctcccgctgaagccccggaactggggagggggcgccccgggacgcgaatggacgtgtctacctgatggcgcgagggaggc

SEQ ID NO: 1446 - DNA, 495 bp, Artificial Sequence
  Synthetic Template Oligonucleotide for TCRB Locus
gccttgccagcccgctcaggaatggacgtacagtgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtacagtggtcgacaaaacattcagtacttcggcgccgggacccggctctcagtgctgggtaagctggggccgccgggggaccggggacgagactgcgctcgggtttttgtgcggaatggacgtacagtgctgatggcgcgagggaggc

SEQ ID NO: 1447 - DNA, 495 bp, Artificial Sequence
  Synthetic Template Oligonucleotide for TCRB Locus
gccttgccagcccgctcaggaatggacggatcatcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacggatcatcgtcgacgagacccagtacttcgggccaggcacgcggctcctggtgctcggtgagcgcgggctgctggggcgcgggcgcgggcggcttgggtctggtttttgcgggggaatggacggatcatcctgatggcgcgagggaggc

SEQ ID NO: 1448 - DNA, 495 bp, Artificial Sequence
  Synthetic Template Oligonucleotide for TCRB Locus
gccttgccagcccgctcaggaatggactattggcgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggactattggcggtcgacgggccaacgtcctgactttcggggccggcagcaggctgaccgtgctgggtgagttttcgcgggaccacccgggcggcgggattcaggtggaaggcggcgggaatggactattggcgctgatggcgcgagggaggc

SEQ ID NO: 1449 - DNA, 495 bp, Artificial Sequence
  Synthetic Template Oligonucleotide for TCRB Locus
gccttgccagcccgctcaggaatggacaggcttgattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacaggcttgagtcgacacgagcagtacttcgggccgggcaccaggctcacggtcacaggtgagattcgggcgtctccccaccttccagcccctcggtccccggagtcggagggtgggaatggacaggcttgactgatggcgcgagggaggc

SEQ ID NO: 1450 - DNA, 495 bp, Artificial Sequence
  Synthetic Template Oligonucleotide for TCRB Locus
gccttgccagcccgctcagagttatgcgacactctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgacactctgtcgacactgaagctttctttggacaaggcaccagactcacagttgtaggtaagacatttttcaggttcttttgcagatccgtcacagggaaaagtgggtccacagagttatgcgacactctctgatggcgcgagggaggc

SEQ ID NO: 1451 - DNA, 495 bp, Artificial Sequence
  Synthetic Template Oligonucleotide for TCRB Locus
gccttgccagcccgctcagagttatgcttcggaaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcttcggaacgtcgactatggctacaccttcggttcggggaccaggttaaccgttgtaggtaaggctgggggtctctaggaggggtgcgatgagggaggactctgtcctgggaaatagttatgcttcggaacctgatggcgcgagggaggc

SEQ ID NO: 1452 - DNA, 495 bp, Artificial Sequence
  Synthetic Template Oligonucleotide for TCRB Locus
gccttgccagcccgctcagagttatgcaagtaacgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcaagtaacggtcgacgaaacaccatatattttggagagggaagttggctcactgttgtaggtgagtaagtcaaggctggacagctgggaacttgcaaaaaggggctggaatccagagttatgcaagtaacgctgatggcgcgagggaggc

SEQ ID NO: 1453 - DNA, 495 bp, Artificial Sequence
  Synthetic Template Oligonucleotide for TCRB Locus
gccttgccagcccgctcagagttatgcgtctcctacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtctcctagtcgacaatgaaaaactgttttttggcagtggaacccagctctctgtcttgggtatgtaaaagacttctttcgggatagtgtatcataaggtcggagttccaggagagttatgcgtctcctactgatggcgcgagggaggc

SEQ ID NO: 1454 - DNA, 495 bp, Artificial Sequence
  Synthetic Template Oligonucleotide for TCRB Locus
gccttgccagcccgctcagagttatgcagagtgtccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcagagtgtcgtcgacatcagccccagcattttggtgatgggactcgactctccatcctaggtaagttgcagaatcagggtggtatggccattgtcccttgaaggcagagttctctagttatgcagagtgtcctgatggcgcgagggaggc

SEQ ID NO: 1455 - DNA, 495 bp, Artificial Sequence
  Synthetic Template Oligonucleotide for TCRB Locus
gccttgccagcccgctcagagttatgcgttccgaacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgttccgaagtcgacataattcacccctccactttgggaacgggaccaggctcactgtgacaggtatgggggctccactcttgactcgggggtgcctgggtttgactgcaatgatagttatgcgttccgaactgatggcgcgagggaggc

SEQ ID NO: 1456 - DNA, 495 bp, Artificial Sequence
  Synthetic Template Oligonucleotide for TCRB Locus
gccttgccagcccgctcagagttatgccgttacttcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgccgttacttgtcgacacaatgagcagttcttcgggccagggacacggctcaccgtgctaggtaagaagggggctccaggtgggagagagggtgagcagcccagcctgcacgacccagttatgccgttacttctgatggcgcgagggaggc

SEQ ID NO: 1457 - DNA, 495 bp, Artificial Sequence
  Synthetic Template Oligonucleotide for TCRB Locus
gccttgccagcccgctcagagttatgctaggagaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgctaggagacgtcgacaccggggagctgttttttggagaaggctctaggctgaccgtactgggtaaggaggcggttggggctccggagagctccgagagggcgggatgggcagaggagttatgctaggagacctgatggcgcgagggaggc

SEQ ID NO: 1458 - DNA, 495 bp, Artificial Sequence
  Synthetic Template Oligonucleotide for TCRB Locus
gccttgccagcccgctcagagttatgcgtgtctaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtgtctacgtcgacagatacgcagtattttggcccaggcacccggctgacagtgctcggtaagcgggggctcccgctgaagccccggaactggggagggggcgccccgggacgcagttatgcgtgtctacctgatggcgcgagggaggc

SEQ ID NO: 1459 - DNA, 495 bp, Artificial Sequence
  Synthetic Template Oligonucleotide for TCRB Locus
gccttgccagcccgctcagagttatgcgtacagtgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtacagtggtcgacaaaacattcagtacttcggcgccgggacccggctctcagtgctgggtaagctggggccgccgggggaccggggacgagactgcgctcgggtttttgtgcgagttatgcgtacagtgctgatggcgcgagggaggc

SEQ ID NO: 1460 - DNA, 495 bp, Artificial Sequence
  Synthetic Template Oligonucleotide for TCRB Locus
gccttgccagcccgctcagagttatgcggatcatccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcggatcatcgtcgacgagacccagtacttcgggccaggcacgcggctcctggtgctcggtgagcgcgggctgctggggcgcgggcgcgggcggcttgggtctggtttttgcggggagttatgcggatcatcctgatggcgcgagggaggc

SEQ ID NO: 1461 - DNA, 495 bp, Artificial Sequence
  Synthetic Template Oligonucleotide for TCRB Locus
gccttgccagcccgctcagagttatgctattggcgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgctattggcggtcgacgggccaacgtcctgactttcggggccggcagcaggctgaccgtgctgggtgagttttcgcgggaccacccgggcggcgggattcaggtggaaggcggcggagttatgctattggcgctgatggcgcgagggaggc

SEQ ID NO: 1462 - DNA, 495 bp, Artificial Sequence
  Synthetic Template Oligonucleotide for TCRB Locus
gccttgccagcccgctcagagttatgcaggcttgacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcaggcttgagtcgacacgagcagtacttcgggccgggcaccaggctcacggtcacaggtgagattcgggcgtctccccaccttccagcccctcggtccccggagtcggagggtggagttatgcaggcttgactgatggcgcgagggaggc

SEQ ID NO: 1463 - DNA, 495 bp, Artificial Sequence
  Synthetic Template Oligonucleotide for TCRB Locus
gccttgccagcccgctcagcagcatatgacactctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgacactctgtcgacactgaagctttctttggacaaggcaccagactcacagttgtaggtaagacatttttcaggttcttttgcagatccgtcacagggaaaagtgggtccacagcagcatatgacactctctgatggcgcgagggaggc

SEQ ID NO: 1464 - DNA, 495 bp, Artificial Sequence
  Synthetic Template Oligonucleotide for TCRB Locus
gccttgccagcccgctcagcagcatatttcggaacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatttcggaacgtcgactatggctacaccttcggttcggggaccaggttaaccgttgtaggtaaggctgggggtctctaggaggggtgcgatgagggaggactctgtcctgggaaatcagcatatttcggaacctgatggcgcgagggaggc

SEQ ID NO: 1465 - DNA, 495 bp, Artificial Sequence
  Synthetic Template Oligonucleotide for TCRB Locus
gccttgccagcccgctcagcagcatataagtaacgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatataagtaacggtcgacgaaacaccatatattttggagagggaagttggctcactgttgtaggtgagtaagtcaaggctggacagctgggaacttgcaaaaaggggctggaatccagcagcatataagtaacgctgatggcgcgagggaggc

SEQ ID NO: 1466 - DNA, 495 bp, Artificial Sequence
  Synthetic Template Oligonucleotide for TCRB Locus
gccttgccagcccgctcagcagcatatgtctcctattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtctcctagtcgacaatgaaaaactgttttttggcagtggaacccagctctctgtcttgggtatgtaaaagacttctttcgggatagtgtatcataaggtcggagttccaggagcagcatatgtctcctactgatggcgcgagggaggc

SEQ ID NO: 1467 - DNA, 495 bp, Artificial Sequence
  Synthetic Template Oligonucleotide for TCRB Locus
gccttgccagcccgctcagcagcatatagagtgtcttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatagagtgtcgtcgacatcagccccagcattttggtgatgggactcgactctccatcctaggtaagttgcagaatcagggtggtatggccattgtcccttgaaggcagagttctctcagcatatagagtgtcctgatggcgcgagggaggc

SEQ ID NO: 1468 - DNA, 495 bp, Artificial Sequence
  Synthetic Template Oligonucleotide for TCRB Locus
gccttgccagcccgctcagcagcatatgttccgaattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgttccgaagtcgacataattcacccctccactttgggaacgggaccaggctcactgtgacaggtatgggggctccactcttgactcgggggtgcctgggtttgactgcaatgatcagcatatgttccgaactgatggcgcgagggaggc

SEQ ID NO: 1469 - DNA, 495 bp, Artificial Sequence
  Synthetic Template Oligonucleotide for TCRB Locus
gccttgccagcccgctcagcagcatatcgttacttttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatcgttacttgtcgacacaatgagcagttcttcgggccagggacacggctcaccgtgctaggtaagaagggggctccaggtgggagagagggtgagcagcccagcctgcacgaccccagcatatcgttacttctgatggcgcgagggaggc

SEQ ID NO: 1470 - DNA, 495 bp, Artificial Sequence
  Synthetic Template Oligonucleotide for TCRB Locus
gccttgccagcccgctcagcagcatattaggagacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatattaggagacgtcgacaccggggagctgttttttggagaaggctctaggctgaccgtactgggtaaggaggcggttggggctccggagagctccgagagggcgggatgggcagaggcagcatattaggagacctgatggcgcgagggaggc

SEQ ID NO: 1471 - DNA, 495 bp, Artificial Sequence
  Synthetic Template Oligonucleotide for TCRB Locus
gccttgccagcccgctcagcagcatatgtgtctacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtgtctacgtcgacagatacgcagtattttggcccaggcacccggctgacagtgctcggtaagcgggggctcccgctgaagccccggaactggggagggggcgccccgggacgccagcatatgtgtctacctgatggcgcgagggaggc

SEQ ID NO: 1472 - DNA, 495 bp, Artificial Sequence
  Synthetic Template Oligonucleotide for TCRB Locus
gccttgccagcccgctcagcagcatatgtacagtgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtacagtggtcgacaaaacattcagtacttcggcgccgggacccggctctcagtgctgggtaagctggggccgccgggggaccggggacgagactgcgctcgggtttttgtgcgcagcatatgtacagtgctgatggcgcgagggaggc

SEQ ID NO: 1473 - DNA, 495 bp, Artificial Sequence
  Synthetic Template Oligonucleotide for TCRB Locus
gccttgccagcccgctcagcagcatatggatcatcttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatggatcatcgtcgacgagacccagtacttcgggccaggcacgcggctcctggtgctcggtgagcgcgggctgctggggcgcgggcgcgggcggcttgggtctggtttttgcggggcagcatatggatcatcctgatggcgcgagggaggc

SEQ ID NO: 1474 - DNA, 495 bp, Artificial Sequence
  Synthetic Template Oligonucleotide for TCRB Locus
gccttgccagcccgctcagcagcatattattggcgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatattattggcggtcgacgggccaacgtcctgactttcggggccggcagcaggctgaccgtgctgggtgagttttcgcgggaccacccgggcggcgggattcaggtggaaggcggcggcagcatattattggcgctgatggcgcgagggaggc

SEQ ID NO: 1475 - DNA, 495 bp, Artificial Sequence
  Synthetic Template Oligonucleotide for TCRB Locus
gccttgccagcccgctcagcagcatataggcttgattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatataggcttgagtcgacacgagcagtacttcgggccgggcaccaggctcacggtcacaggtgagattcgggcgtctccccaccttccagcccctcggtccccggagtcggagggtggcagcatataggcttgactgatggcgcgagggaggc

SEQ ID NO: 1476 - DNA, 495 bp, Artificial Sequence
  Synthetic Template Oligonucleotide for TCRB Locus
gccttgccagcccgctcaggcaggattgacactctaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgacactctgtcgacactgaagctttctttggacaaggcaccagactcacagttgtaggtaagacatttttcaggttcttttgcagatccgtcacagggaaaagtgggtccacaggcaggattgacactctctgatggcgcgagggaggc

SEQ ID NO: 1477 - DNA, 495 bp, Artificial Sequence
  Synthetic Template Oligonucleotide for TCRB Locus
gccttgccagcccgctcaggcaggattttcggaacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattttcggaacgtcgactatggctacaccttcggttcggggaccaggttaaccgttgtaggtaaggctgggggtctctaggaggggtgcgatgagggaggactctgtcctgggaaatgcaggattttcggaacctgatggcgcgagggaggc

SEQ ID NO: 1478 - DNA, 495 bp, Artificial Sequence
  Synthetic Template Oligonucleotide for TCRB Locus
gccttgccagcccgctcaggcaggattaagtaacgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattaagtaacggtcgacgaaacaccatatattttggagagggaagttggctcactgttgtaggtgagtaagtcaaggctggacagctgggaacttgcaaaaaggggctggaatccaggcaggattaagtaacgctgatggcgcgagggaggc

SEQ ID NO: 1479 - DNA, 495 bp, Artificial Sequence
  Synthetic Template Oligonucleotide for TCRB Locus
gccttgccagcccgctcaggcaggattgtctcctaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtctcctagtcgacaatgaaaaactgttttttggcagtggaacccagctctctgtcttgggtatgtaaaagacttctttcgggatagtgtatcataaggtcggagttccaggaggcaggattgtctcctactgatggcgcgagggaggc

SEQ ID NO: 1480 - DNA, 495 bp, Artificial Sequence
  Synthetic Template Oligonucleotide for TCRB Locus
gccttgccagcccgctcaggcaggattagagtgtcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattagagtgtcgtcgacatcagccccagcattttggtgatgggactcgactctccatcctaggtaagttgcagaatcagggtggtatggccattgtcccttgaaggcagagttctctgcaggattagagtgtcctgatggcgcgagggaggc

SEQ ID NO: 1481 - DNA, 495 bp, Artificial Sequence
  Synthetic Template Oligonucleotide for TCRB Locus
gccttgccagcccgctcaggcaggattgttccgaaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgttccgaagtcgacataattcacccctccactttgggaacgggaccaggctcactgtgacaggtatgggggctccactcttgactcgggggtgcctgggtttgactgcaatgatgcaggattgttccgaactgatggcgcgagggaggc

SEQ ID NO: 1482 - DNA, 495 bp, Artificial Sequence
  Synthetic Template Oligonucleotide for TCRB Locus
gccttgccagcccgctcaggcaggattcgttacttaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattcgttacttgtcgacacaatgagcagttcttcgggccagggacacggctcaccgtgctaggtaagaagggggctccaggtgggagagagggtgagcagcccagcctgcacgacccgcaggattcgttacttctgatggcgcgagggaggc

SEQ ID NO: 1483 - DNA, 495 bp, Artificial Sequence
  Synthetic Template Oligonucleotide for TCRB Locus
gccttgccagcccgctcaggcaggatttaggagacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggatttaggagacgtcgacaccggggagctgttttttggagaaggctctaggctgaccgtactgggtaaggaggcggttggggctccggagagctccgagagggcgggatgggcagagggcaggatttaggagacctgatggcgcgagggaggc

SEQ ID NO: 1484 - DNA, 495 bp, Artificial Sequence
  Synthetic Template Oligonucleotide for TCRB Locus
gccttgccagcccgctcaggcaggattgtgtctacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtgtctacgtcgacagatacgcagtattttggcccaggcacccggctgacagtgctcggtaagcgggggctcccgctgaagccccggaactggggagggggcgccccgggacgcgcaggattgtgtctacctgatggcgcgagggaggc

SEQ ID NO: 1485 - DNA, 495 bp, Artificial Sequence
  Synthetic Template Oligonucleotide for TCRB Locus
gccttgccagcccgctcaggcaggattgtacagtgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtacagtggtcgacaaaacattcagtacttcggcgccgggacccggctctcagtgctgggtaagctggggccgccgggggaccggggacgagactgcgctcgggtttttgtgcggcaggattgtacagtgctgatggcgcgagggaggc

SEQ ID NO: 1486 - DNA, 495 bp, Artificial Sequence
  Synthetic Template Oligonucleotide for TCRB Locus
gccttgccagcccgctcaggcaggattggatcatcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattggatcatcgtcgacgagacccagtacttcgggccaggcacgcggctcctggtgctcggtgagcgcgggctgctggggcgcgggcgcgggcggcttgggtctggtttttgcgggggcaggattggatcatcctgatggcgcgagggaggc

SEQ ID NO: 1487 - DNA, 495 bp, Artificial Sequence
  Synthetic Template Oligonucleotide for TCRB Locus
gccttgccagcccgctcaggcaggatttattggcgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggatttattggcggtcgacgggccaacgtcctgactttcggggccggcagcaggctgaccgtgctgggtgagttttcgcgggaccacccgggcggcgggattcaggtggaaggcggcgggcaggatttattggcgctgatggcgcgagggaggc

SEQ ID NO: 1488 - DNA, 495 bp, Artificial Sequence
  Synthetic Template Oligonucleotide for TCRB Locus
gccttgccagcccgctcaggcaggattaggcttgaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattaggcttgagtcgacacgagcagtacttcgggccgggcaccaggctcacggtcacaggtgagattcgggcgtctccccaccttccagcccctcggtccccggagtcggagggtgggcaggattaggcttgactgatggcgcgagggaggc

SEQ ID NO: 1489 - DNA, 495 bp, Artificial Sequence
  Synthetic Template Oligonucleotide for TCRB Locus
gccttgccagcccgctcagaggtctcagacactctctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagacactctgtcgacactgaagctttctttggacaaggcaccagactcacagttgtaggtaagacatttttcaggttcttttgcagatccgtcacagggaaaagtgggtccacagaggtctcagacactctctgatggcgcgagggaggc

SEQ ID NO: 1490 - DNA, 495 bp, Artificial Sequence
  Synthetic Template Oligonucleotide for TCRB Locus
gccttgccagcccgctcagaggtctcattcggaacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcattcggaacgtcgactatggctacaccttcggttcggggaccaggttaaccgttgtaggtaaggctgggggtctctaggaggggtgcgatgagggaggactctgtcctgggaaataggtctcattcggaacctgatggcgcgagggaggc

SEQ ID NO: 1491 - DNA, 495 bp, Artificial Sequence
  Synthetic Template Oligonucleotide for TCRB Locus
gccttgccagcccgctcagaggtctcaaagtaacgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaaagtaacggtcgacgaaacaccatatattttggagagggaagttggctcactgttgtaggtgagtaagtcaaggctggacagctgggaacttgcaaaaaggggctggaatccagaggtctcaaagtaacgctgatggcgcgagggaggc

SEQ ID NO: 1492 - DNA, 495 bp, Artificial Sequence
  Synthetic Template Oligonucleotide for TCRB Locus
gccttgccagcccgctcagaggtctcagtctcctactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtctcctagtcgacaatgaaaaactgttttttggcagtggaacccagctctctgtcttgggtatgtaaaagacttctttcgggatagtgtatcataaggtcggagttccaggagaggtctcagtctcctactgatggcgcgagggaggc

SEQ ID NO: 1493 - DNA, 495 bp, Artificial Sequence
  Synthetic Template Oligonucleotide for TCRB Locus
gccttgccagcccgctcagaggtctcaagagtgtcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaagagtgtcgtcgacatcagccccagcattttggtgatgggactcgactctccatcctaggtaagttgcagaatcagggtggtatggccattgtcccttgaaggcagagttctctaggtctcaagagtgtcctgatggcgcgagggaggc

SEQ ID NO: 1494 - DNA, 495 bp, Artificial Sequence
  Synthetic Template Oligonucleotide for TCRB Locus
gccttgccagcccgctcagaggtctcagttccgaactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagttccgaagtcgacataattcacccctccactttgggaacgggaccaggctcactgtgacaggtatgggggctccactcttgactcgggggtgcctgggtttgactgcaatgataggtctcagttccgaactgatggcgcgagggaggc

SEQ ID NO: 1495 - DNA, 495 bp, Artificial Sequence
  Synthetic Template Oligonucleotide for TCRB Locus
gccttgccagcccgctcagaggtctcacgttacttctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcacgttacttgtcgacacaatgagcagttcttcgggccagggacacggctcaccgtgctaggtaagaagggggctccaggtgggagagagggtgagcagcccagcctgcacgacccaggtctcacgttacttctgatggcgcgagggaggc

SEQ ID NO: 1496 - DNA, 495 bp, Artificial Sequence
  Synthetic Template Oligonucleotide for TCRB Locus
gccttgccagcccgctcagaggtctcataggagacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcataggagacgtcgacaccggggagctgttttttggagaaggctctaggctgaccgtactgggtaaggaggcggttggggctccggagagctccgagagggcgggatgggcagaggaggtctcataggagacctgatggcgcgagggaggc

SEQ ID NO: 1497 - DNA, 495 bp, Artificial Sequence
  Synthetic Template Oligonucleotide for TCRB Locus
gccttgccagcccgctcagaggtctcagtgtctacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtgtctacgtcgacagatacgcagtattttggcccaggcacccggctgacagtgctcggtaagcgggggctcccgctgaagccccggaactggggagggggcgccccgggacgcaggtctcagtgtctacctgatggcgcgagggaggc

SEQ ID NO: 1498 - DNA, 495 bp, Artificial Sequence
  Synthetic Template Oligonucleotide for TCRB Locus
gccttgccagcccgctcagaggtctcagtacagtgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtacagtggtcgacaaaacattcagtacttcggcgccgggacccggctctcagtgctgggtaagctggggccgccgggggaccggggacgagactgcgctcgggtttttgtgcgaggtctcagtacagtgctgatggcgcgagggaggc

SEQ ID NO: 1499 - DNA, 495 bp, Artificial Sequence
  Synthetic Template Oligonucleotide for TCRB Locus
gccttgccagcccgctcagaggtctcaggatcatcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaggatcatcgtcgacgagacccagtacttcgggccaggcacgcggctcctggtgctcggtgagcgcgggctgctggggcgcgggcgcgggcggcttgggtctggtttttgcggggaggtctcaggatcatcctgatggcgcgagggaggc

SEQ ID NO: 1500 - DNA, 495 bp, Artificial Sequence
  Synthetic Template Oligonucleotide for TCRB Locus
gccttgccagcccgctcagaggtctcatattggcgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcatattggcggtcgacgggccaacgtcctgactttcggggccggcagcaggctgaccgtgctgggtgagttttcgcgggaccacccgggcggcgggattcaggtggaaggcggcggaggtctcatattggcgctgatggcgcgagggaggc

SEQ ID NO: 1501 - DNA, 495 bp, Artificial Sequence
  Synthetic Template Oligonucleotide for TCRB Locus
gccttgccagcccgctcagaggtctcaaggcttgactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaaggcttgagtcgacacgagcagtacttcgggccgggcaccaggctcacggtcacaggtgagattcgggcgtctccccaccttccagcccctcggtccccggagtcggagggtggaggtctcaaggcttgactgatggcgcgagggaggc

SEQ ID NO: 1502 - DNA, 495 bp, Artificial Sequence
  Synthetic Template Oligonucleotide for TCRB Locus
gccttgccagcccgctcaggtccattcgacactctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgacactctgtcgacactgaagctttctttggacaaggcaccagactcacagttgtaggtaagacatttttcaggttcttttgcagatccgtcacagggaaaagtgggtccacaggtccattcgacactctctgatggcgcgagggaggc

SEQ ID NO: 1503 - DNA, 495 bp, Artificial Sequence
  Synthetic Template Oligonucleotide for TCRB Locus
gccttgccagcccgctcaggtccattcttcggaacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcttcggaacgtcgactatggctacaccttcggttcggggaccaggttaaccgttgtaggtaaggctgggggtctctaggaggggtgcgatgagggaggactctgtcctgggaaatgtccattcttcggaacctgatggcgcgagggaggc

SEQ ID NO: 1504 - DNA, 495 bp, Artificial Sequence
  Synthetic Template Oligonucleotide for TCRB Locus
gccttgccagcccgctcaggtccattcaagtaacgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcaagtaacggtcgacgaaacaccatatattttggagagggaagttggctcactgttgtaggtgagtaagtcaaggctggacagctgggaacttgcaaaaaggggctggaatccaggtccattcaagtaacgctgatggcgcgagggaggc

SEQ ID NO: 1505 - DNA, 495 bp, Artificial Sequence
  Synthetic Template Oligonucleotide for TCRB Locus
gccttgccagcccgctcaggtccattcgtctcctattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtctcctagtcgacaatgaaaaactgttttttggcagtggaacccagctctctgtcttgggtatgtaaaagacttctttcgggatagtgtatcataaggtcggagttccaggaggtccattcgtctcctactgatggcgcgagggaggc

SEQ ID NO: 1506 - DNA, 495 bp, Artificial Sequence
  Synthetic Template Oligonucleotide for TCRB Locus
gccttgccagcccgctcaggtccattcagagtgtcttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcagagtgtcgtcgacatcagccccagcattttggtgatgggactcgactctccatcctaggtaagttgcagaatcagggtggtatggccattgtcccttgaaggcagagttctctgtccattcagagtgtcctgatggcgcgagggaggc

SEQ ID NO: 1507 - DNA, 495 bp, Artificial Sequence
  Synthetic Template Oligonucleotide for TCRB Locus
gccttgccagcccgctcaggtccattcgttccgaattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgttccgaagtcgacataattcacccctccactttgggaacgggaccaggctcactgtgacaggtatgggggctccactcttgactcgggggtgcctgggtttgactgcaatgatgtccattcgttccgaactgatggcgcgagggaggc

SEQ ID NO: 1508 - DNA, 495 bp, Artificial Sequence
  Synthetic Template Oligonucleotide for TCRB Locus
gccttgccagcccgctcaggtccattccgttacttttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattccgttacttgtcgacacaatgagcagttcttcgggccagggacacggctcaccgtgctaggtaagaagggggctccaggtgggagagagggtgagcagcccagcctgcacgacccgtccattccgttacttctgatggcgcgagggaggc

SEQ ID NO: 1509 - DNA, 495 bp, Artificial Sequence
  Synthetic Template Oligonucleotide for TCRB Locus
gccttgccagcccgctcaggtccattctaggagacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattctaggagacgtcgacaccggggagctgttttttggagaaggctctaggctgaccgtactgggtaaggaggcggttggggctccggagagctccgagagggcgggatgggcagagggtccattctaggagacctgatggcgcgagggaggc

SEQ ID NO: 1510 - DNA, 495 bp, Artificial Sequence
  Synthetic Template Oligonucleotide for TCRB Locus
gccttgccagcccgctcaggtccattcgtgtctacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtgtctacgtcgacagatacgcagtattttggcccaggcacccggctgacagtgctcggtaagcgggggctcccgctgaagccccggaactggggagggggcgccccgggacgcgtccattcgtgtctacctgatggcgcgagggaggc

SEQ ID NO: 1511 - DNA, 495 bp, Artificial Sequence
  Synthetic Template Oligonucleotide for TCRB Locus
gccttgccagcccgctcaggtccattcgtacagtgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtacagtggtcgacaaaacattcagtacttcggcgccgggacccggctctcagtgctgggtaagctggggccgccgggggaccggggacgagactgcgctcgggtttttgtgcggtccattcgtacagtgctgatggcgcgagggaggc

SEQ ID NO: 1512 - DNA, 495 bp, Artificial Sequence
  Synthetic Template Oligonucleotide for TCRB Locus
gccttgccagcccgctcaggtccattcggatcatcttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcggatcatcgtcgacgagacccagtacttcgggccaggcacgcggctcctggtgctcggtgagcgcgggctgctggggcgcgggcgcgggcggcttgggtctggtttttgcgggggtccattcggatcatcctgatggcgcgagggaggc

SEQ ID NO: 1513 - DNA, 495 bp, Artificial Sequence
  Synthetic Template Oligonucleotide for TCRB Locus
gccttgccagcccgctcaggtccattctattggcgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattctattggcggtcgacgggccaacgtcctgactttcggggccggcagcaggctgaccgtgctgggtgagttttcgcgggaccacccgggcggcgggattcaggtggaaggcggcgggtccattctattggcgctgatggcgcgagggaggc

SEQ ID NO: 1514 - DNA, 495 bp, Artificial Sequence
  Synthetic Template Oligonucleotide for TCRB Locus
gccttgccagcccgctcaggtccattcaggcttgattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcaggcttgagtcgacacgagcagtacttcgggccgggcaccaggctcacggtcacaggtgagattcgggcgtctccccaccttccagcccctcggtccccggagtcggagggtgggtccattcaggcttgactgatggcgcgagggaggc

SEQ ID NO: 1515 - DNA, 495 bp, Artificial Sequence
  Synthetic Template Oligonucleotide for TCRB Locus
gccttgccagcccgctcagactatgacgacactcttcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgacactctgtcgacactgaagctttctttggacaaggcaccagactcacagttgtaggtaagacatttttcaggttcttttgcagatccgtcacagggaaaagtgggtccacagactatgacgacactctctgatggcgcgagggaggc

SEQ ID NO: 1516 - DNA, 495 bp, Artificial Sequence
  Synthetic Template Oligonucleotide for TCRB Locus
gccttgccagcccgctcagactatgacttcggaactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacttcggaacgtcgactatggctacaccttcggttcggggaccaggttaaccgttgtaggtaaggctgggggtctctaggaggggtgcgatgagggaggactctgtcctgggaaatactatgacttcggaacctgatggcgcgagggaggc

SEQ ID NO: 1517 - DNA, 495 bp, Artificial Sequence
  Synthetic Template Oligonucleotide for TCRB Locus
gccttgccagcccgctcagactatgacaagtaacgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacaagtaacggtcgacgaaacaccatatattttggagagggaagttggctcactgttgtaggtgagtaagtcaaggctggacagctgggaacttgcaaaaaggggctggaatccagactatgacaagtaacgctgatggcgcgagggaggc

SEQ ID NO: 1518 - DNA, 495 bp, Artificial Sequence
  Synthetic Template Oligonucleotide for TCRB Locus
gccttgccagcccgctcagactatgacgtctcctatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtctcctagtcgacaatgaaaaactgttttttggcagtggaacccagctctctgtcttgggtatgtaaaagacttctttcgggatagtgtatcataaggtcggagttccaggagactatgacgtctcctactgatggcgcgagggaggc

SEQ ID NO: 1519 - DNA, 495 bp, Artificial Sequence
  Synthetic Template Oligonucleotide for TCRB Locus
gccttgccagcccgctcagactatgacagagtgtctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacagagtgtcgtcgacatcagccccagcattttggtgatgggactcgactctccatcctaggtaagttgcagaatcagggtggtatggccattgtcccttgaaggcagagttctctactatgacagagtgtcctgatggcgcgagggaggc

SEQ ID NO: 1520 - DNA, 495 bp, Artificial Sequence
  Synthetic Template Oligonucleotide for TCRB Locus
gccttgccagcccgctcagactatgacgttccgaatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgttccgaagtcgacataattcacccctccactttgggaacgggaccaggctcactgtgacaggtatgggggctccactcttgactcgggggtgcctgggtttgactgcaatgatactatgacgttccgaactgatggcgcgagggaggc

SEQ ID NO: 1521 - DNA, 495 bp, Artificial Sequence
  Synthetic Template Oligonucleotide for TCRB Locus
gccttgccagcccgctcagactatgaccgttactttcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgaccgttacttgtcgacacaatgagcagttcttcgggccagggacacggctcaccgtgctaggtaagaagggggctccaggtgggagagagggtgagcagcccagcctgcacgacccactatgaccgttacttctgatggcgcgagggaggc

SEQ ID NO: 1522 - DNA, 495 bp, Artificial Sequence
  Synthetic Template Oligonucleotide for TCRB Locus
gccttgccagcccgctcagactatgactaggagactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgactaggagacgtcgacaccggggagctgttttttggagaaggctctaggctgaccgtactgggtaaggaggcggttggggctccggagagctccgagagggcgggatgggcagaggactatgactaggagacctgatggcgcgagggaggc

SEQ ID NO: 1523 - DNA, 495 bp, Artificial Sequence
  Synthetic Template Oligonucleotide for TCRB Locus
gccttgccagcccgctcagactatgacgtgtctactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtgtctacgtcgacagatacgcagtattttggcccaggcacccggctgacagtgctcggtaagcgggggctcccgctgaagccccggaactggggagggggcgccccgggacgcactatgacgtgtctacctgatggcgcgagggaggc

SEQ ID NO: 1524 - DNA, 495 bp, Artificial Sequence
  Synthetic Template Oligonucleotide for TCRB Locus
gccttgccagcccgctcagactatgacgtacagtgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtacagtggtcgacaaaacattcagtacttcggcgccgggacccggctctcagtgctgggtaagctggggccgccgggggaccggggacgagactgcgctcgggtttttgtgcgactatgacgtacagtgctgatggcgcgagggaggc

SEQ ID NO: 1525 - DNA, 495 bp, Artificial Sequence
  Synthetic Template Oligonucleotide for TCRB Locus
gccttgccagcccgctcagactatgacggatcatctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacggatcatcgtcgacgagacccagtacttcgggccaggcacgcggctcctggtgctcggtgagcgcgggctgctggggcgcgggcgcgggcggcttgggtctggtttttgcggggactatgacggatcatcctgatggcgcgagggaggc

SEQ ID NO: 1526 - DNA, 495 bp, Artificial Sequence
  Synthetic Template Oligonucleotide for TCRB Locus
gccttgccagcccgctcagactatgactattggcgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgactattggcggtcgacgggccaacgtcctgactttcggggccggcagcaggctgaccgtgctgggtgagttttcgcgggaccacccgggcggcgggattcaggtggaaggcggcggactatgactattggcgctgatggcgcgagggaggc

SEQ ID NO: 1527 - DNA, 495 bp, Artificial Sequence
  Synthetic Template Oligonucleotide for TCRB Locus
gccttgccagcccgctcagactatgacaggcttgatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacaggcttgagtcgacacgagcagtacttcgggccgggcaccaggctcacggtcacaggtgagattcgggcgtctccccaccttccagcccctcggtccccggagtcggagggtggactatgacaggcttgactgatggcgcgagggaggc

SEQ ID NO: 1528 - DNA, 495 bp, Artificial Sequence
  Synthetic Template Oligonucleotide for TCRB Locus
gccttgccagcccgctcagtccatgtggacactctatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggacactctgtcgacactgaagctttctttggacaaggcaccagactcacagttgtaggtaagacatttttcaggttcttttgcagatccgtcacagggaaaagtgggtccacagtccatgtggacactctctgatggcgcgagggaggc

SEQ ID NO: 1529 - DNA, 495 bp, Artificial Sequence
  Synthetic Template Oligonucleotide for TCRB Locus
gccttgccagcccgctcagtccatgtgttcggaacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgttcggaacgtcgactatggctacaccttcggttcggggaccaggttaaccgttgtaggtaaggctgggggtctctaggaggggtgcgatgagggaggactctgtcctgggaaattccatgtgttcggaacctgatggcgcgagggaggc

SEQ ID NO: 1530 - DNA, 495 bp, Artificial Sequence
  Synthetic Template Oligonucleotide for TCRB Locus
gccttgccagcccgctcagtccatgtgaagtaacgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgaagtaacggtcgacgaaacaccatatattttggagagggaagttggctcactgttgtaggtgagtaagtcaaggctggacagctgggaacttgcaaaaaggggctggaatccagtccatgtgaagtaacgctgatggcgcgagggaggc

SEQ ID NO: 1531 - DNA, 495 bp, Artificial Sequence
  Synthetic Template Oligonucleotide for TCRB Locus
gccttgccagcccgctcagtccatgtggtctcctaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtctcctagtcgacaatgaaaaactgttttttggcagtggaacccagctctctgtcttgggtatgtaaaagacttctttcgggatagtgtatcataaggtcggagttccaggagtccatgtggtctcctactgatggcgcgagggaggc

SEQ ID NO: 1532 - DNA, 495 bp, Artificial Sequence
  Synthetic Template Oligonucleotide for TCRB Locus
gccttgccagcccgctcagtccatgtgagagtgtcatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgagagtgtcgtcgacatcagccccagcattttggtgatgggactcgactctccatcctaggtaagttgcagaatcagggtggtatggccattgtcccttgaaggcagagttctcttccatgtgagagtgtcctgatggcgcgagggaggc

SEQ ID NO: 1533 - DNA, 495 bp, Artificial Sequence
  Synthetic Template Oligonucleotide for TCRB Locus
gccttgccagcccgctcagtccatgtggttccgaaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggttccgaagtcgacataattcacccctccactttgggaacgggaccaggctcactgtgacaggtatgggggctccactcttgactcgggggtgcctgggtttgactgcaatgattccatgtggttccgaactgatggcgcgagggaggc

SEQ ID NO: 1534 - DNA, 495 bp, Artificial Sequence
  Synthetic Template Oligonucleotide for TCRB Locus
gccttgccagcccgctcagtccatgtgcgttacttatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgcgttacttgtcgacacaatgagcagttcttcgggccagggacacggctcaccgtgctaggtaagaagggggctccaggtgggagagagggtgagcagcccagcctgcacgaccctccatgtgcgttacttctgatggcgcgagggaggc

SEQ ID NO: 1535 - DNA, 495 bp, Artificial Sequence
  Synthetic Template Oligonucleotide for TCRB Locus
gccttgccagcccgctcagtccatgtgtaggagacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgtaggagacgtcgacaccggggagctgttttttggagaaggctctaggctgaccgtactgggtaaggaggcggttggggctccggagagctccgagagggcgggatgggcagaggtccatgtgtaggagacctgatggcgcgagggaggc

SEQ ID NO: 1536 - DNA, 495 bp, Artificial Sequence
  Synthetic Template Oligonucleotide for TCRB Locus
gccttgccagcccgctcagtccatgtggtgtctacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtgtctacgtcgacagatacgcagtattttggcccaggcacccggctgacagtgctcggtaagcgggggctcccgctgaagccccggaactggggagggggcgccccgggacgctccatgtggtgtctacctgatggcgcgagggaggc

SEQ ID NO: 1537 - DNA, 495 bp, Artificial Sequence
  Synthetic Template Oligonucleotide for TCRB Locus
gccttgccagcccgctcagtccatgtggtacagtgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtacagtggtcgacaaaacattcagtacttcggcgccgggacccggctctcagtgctgggtaagctggggccgccgggggaccggggacgagactgcgctcgggtttttgtgcgtccatgtggtacagtgctgatggcgcgagggaggc

SEQ ID NO: 1538 - DNA, 495 bp, Artificial Sequence
  Synthetic Template Oligonucleotide for TCRB Locus
gccttgccagcccgctcagtccatgtgggatcatcatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgggatcatcgtcgacgagacccagtacttcgggccaggcacgcggctcctggtgctcggtgagcgcgggctgctggggcgcgggcgcgggcggcttgggtctggtttttgcggggtccatgtgggatcatcctgatggcgcgagggaggc

SEQ ID NO: 1539 - DNA, 495 bp, Artificial Sequence
  Synthetic Template Oligonucleotide for TCRB Locus
gccttgccagcccgctcagtccatgtgtattggcgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgtattggcggtcgacgggccaacgtcctgactttcggggccggcagcaggctgaccgtgctgggtgagttttcgcgggaccacccgggcggcgggattcaggtggaaggcggcggtccatgtgtattggcgctgatggcgcgagggaggc

SEQ ID NO: 1540 - DNA, 495 bp, Artificial Sequence
  Synthetic Template Oligonucleotide for TCRB Locus
gccttgccagcccgctcagtccatgtgaggcttgaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgaggcttgagtcgacacgagcagtacttcgggccgggcaccaggctcacggtcacaggtgagattcgggcgtctccccaccttccagcccctcggtccccggagtcggagggtggtccatgtgaggcttgactgatggcgcgagggaggc

SEQ ID NO: 1541 - DNA, 495 bp, Artificial Sequence
  Synthetic Template Oligonucleotide for TCRB Locus
gccttgccagcccgctcagatggtcaagacactcttcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagacactctgtcgacactgaagctttctttggacaaggcaccagactcacagttgtaggtaagacatttttcaggttcttttgcagatccgtcacagggaaaagtgggtccacagatggtcaagacactctctgatggcgcgagggaggc

SEQ ID NO: 1542 - DNA, 495 bp, Artificial Sequence
  Synthetic Template Oligonucleotide for TCRB Locus
gccttgccagcccgctcagatggtcaattcggaactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaattcggaacgtcgactatggctacaccttcggttcggggaccaggttaaccgttgtaggtaaggctgggggtctctaggaggggtgcgatgagggaggactctgtcctgggaaatatggtcaattcggaacctgatggcgcgagggaggc

SEQ ID NO: 1543 - DNA, 495 bp, Artificial Sequence
  Synthetic Template Oligonucleotide for TCRB Locus
gccttgccagcccgctcagatggtcaaaagtaacgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaaagtaacggtcgacgaaacaccatatattttggagagggaagttggctcactgttgtaggtgagtaagtcaaggctggacagctgggaacttgcaaaaaggggctggaatccagatggtcaaaagtaacgctgatggcgcgagggaggc

SEQ ID NO: 1544 - DNA, 495 bp, Artificial Sequence
  Synthetic Template Oligonucleotide for TCRB Locus
gccttgccagcccgctcagatggtcaagtctcctatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtctcctagtcgacaatgaaaaactgttttttggcagtggaacccagctctctgtcttgggtatgtaaaagacttctttcgggatagtgtatcataaggtcggagttccaggagatggtcaagtctcctactgatggcgcgagggaggc

SEQ ID NO: 1545 - DNA, 495 bp, Artificial Sequence
  Synthetic Template Oligonucleotide for TCRB Locus
gccttgccagcccgctcagatggtcaaagagtgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaagagtgtcgtcgacatcagccccagcattttggtgatgggactcgactctccatcctaggtaagttgcagaatcagggtggtatggccattgtcccttgaaggcagagttctctatggtcaaagagtgtcctgatggcgcgagggaggc

SEQ ID NO: 1546 - DNA, 495 bp, Artificial Sequence
  Synthetic Template Oligonucleotide for TCRB Locus
gccttgccagcccgctcagatggtcaagttccgaatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagttccgaagtcgacataattcacccctccactttgggaacgggaccaggctcactgtgacaggtatgggggctccactcttgactcgggggtgcctgggtttgactgcaatgatatggtcaagttccgaactgatggcgcgagggaggc

SEQ ID NO: 1547 - DNA, 495 bp, Artificial Sequence
  Synthetic Template Oligonucleotide for TCRB Locus
gccttgccagcccgctcagatggtcaacgttactttcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaacgttacttgtcgacacaatgagcagttcttcgggccagggacacggctcaccgtgctaggtaagaagggggctccaggtgggagagagggtgagcagcccagcctgcacgacccatggtcaacgttacttctgatggcgcgagggaggc

SEQ ID NO: 1548 - DNA, 495 bp, Artificial Sequence
  Synthetic Template Oligonucleotide for TCRB Locus
gccttgccagcccgctcagatggtcaataggagactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaataggagacgtcgacaccggggagctgttttttggagaaggctctaggctgaccgtactgggtaaggaggcggttggggctccggagagctccgagagggcgggatgggcagaggatggtcaataggagacctgatggcgcgagggaggc

SEQ ID NO: 1549 - DNA, 495 bp, Artificial Sequence
  Synthetic Template Oligonucleotide for TCRB Locus
gccttgccagcccgctcagatggtcaagtgtctactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtgtctacgtcgacagatacgcagtattttggcccaggcacccggctgacagtgctcggtaagcgggggctcccgctgaagccccggaactggggagggggcgccccgggacgcatggtcaagtgtctacctgatggcgcgagggaggc

SEQ ID NO: 1550 - DNA, 495 bp, Artificial Sequence
  Synthetic Template Oligonucleotide for TCRB Locus
gccttgccagcccgctcagatggtcaagtacagtgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtacagtggtcgacaaaacattcagtacttcggcgccgggacccggctctcagtgctgggtaagctggggccgccgggggaccggggacgagactgcgctcgggtttttgtgcgatggtcaagtacagtgctgatggcgcgagggaggc

SEQ ID NO: 1551 - DNA, 495 bp, Artificial Sequence
  Synthetic Template Oligonucleotide for TCRB Locus
gccttgccagcccgctcagatggtcaaggatcatctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaggatcatcgtcgacgagacccagtacttcgggccaggcacgcggctcctggtgctcggtgagcgcgggctgctggggcgcgggcgcgggcggcttgggtctggtttttgcggggatggtcaaggatcatcctgatggcgcgagggaggc

SEQ ID NO: 1552 - DNA, 495 bp, Artificial Sequence
  Synthetic Template Oligonucleotide for TCRB Locus
gccttgccagcccgctcagatggtcaatattggcgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaatattggcggtcgacgggccaacgtcctgactttcggggccggcagcaggctgaccgtgctgggtgagttttcgcgggaccacccgggcggcgggattcaggtggaaggcggcggatggtcaatattggcgctgatggcgcgagggaggc

SEQ ID NO: 1553 - DNA, 495 bp, Artificial Sequence
  Synthetic Template Oligonucleotide for TCRB Locus
gccttgccagcccgctcagatggtcaaaggcttgatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaaggcttgagtcgacacgagcagtacttcgggccgggcaccaggctcacggtcacaggtgagattcgggcgtctccccaccttccagcccctcggtccccggagtcggagggtggatggtcaaaggcttgactgatggcgcgagggaggc

SEQ ID NO: 1554 - DNA, 495 bp, Artificial Sequence
  Synthetic Template Oligonucleotide for TCRB Locus
gccttgccagcccgctcagcaagtcacgacactctccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgacactctgtcgacactgaagctttctttggacaaggcaccagactcacagttgtaggtaagacatttttcaggttcttttgcagatccgtcacagggaaaagtgggtccacagcaagtcacgacactctctgatggcgcgagggaggc

SEQ ID NO: 1555 - DNA, 495 bp, Artificial Sequence
  Synthetic Template Oligonucleotide for TCRB Locus
gccttgccagcccgctcagcaagtcacttcggaacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacttcggaacgtcgactatggctacaccttcggttcggggaccaggttaaccgttgtaggtaaggctgggggtctctaggaggggtgcgatgagggaggactctgtcctgggaaatcaagtcacttcggaacctgatggcgcgagggaggc

SEQ ID NO: 1556 - DNA, 495 bp, Artificial Sequence
  Synthetic Template Oligonucleotide for TCRB Locus
gccttgccagcccgctcagcaagtcacaagtaacgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacaagtaacggtcgacgaaacaccatatattttggagagggaagttggctcactgttgtaggtgagtaagtcaaggctggacagctgggaacttgcaaaaaggggctggaatccagcaagtcacaagtaacgctgatggcgcgagggaggc

SEQ ID NO: 1557 - DNA, 495 bp, Artificial Sequence
  Synthetic Template Oligonucleotide for TCRB Locus
gccttgccagcccgctcagcaagtcacgtctcctaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtctcctagtcgacaatgaaaaactgttttttggcagtggaacccagctctctgtcttgggtatgtaaaagacttctttcgggatagtgtatcataaggtcggagttccaggagcaagtcacgtctcctactgatggcgcgagggaggc

SEQ ID NO: 1558 - DNA, 495 bp, Artificial Sequence
  Synthetic Template Oligonucleotide for TCRB Locus
gccttgccagcccgctcagcaagtcacagagtgtcccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacagagtgtcgtcgacatcagccccagcattttggtgatgggactcgactctccatcctaggtaagttgcagaatcagggtggtatggccattgtcccttgaaggcagagttctctcaagtcacagagtgtcctgatggcgcgagggaggc

SEQ ID NO: 1559 - DNA, 495 bp, Artificial Sequence
  Synthetic Template Oligonucleotide for TCRB Locus
gccttgccagcccgctcagcaagtcacgttccgaaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgttccgaagtcgacataattcacccctccactttgggaacgggaccaggctcactgtgacaggtatgggggctccactcttgactcgggggtgcctgggtttgactgcaatgatcaagtcacgttccgaactgatggcgcgagggaggc

SEQ ID NO: 1560 - DNA, 495 bp, Artificial Sequence
  Synthetic Template Oligonucleotide for TCRB Locus
gccttgccagcccgctcagcaagtcaccgttacttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcaccgttacttgtcgacacaatgagcagttcttcgggccagggacacggctcaccgtgctaggtaagaagggggctccaggtgggagagagggtgagcagcccagcctgcacgaccccaagtcaccgttacttctgatggcgcgagggaggc

SEQ ID NO: 1561 - DNA, 495 bp, Artificial Sequence
  Synthetic Template Oligonucleotide for TCRB Locus
gccttgccagcccgctcagcaagtcactaggagacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcactaggagacgtcgacaccggggagctgttttttggagaaggctctaggctgaccgtactgggtaaggaggcggttggggctccggagagctccgagagggcgggatgggcagaggcaagtcactaggagacctgatggcgcgagggaggc

SEQ ID NO: 1562 - DNA, 495 bp, Artificial Sequence
  Synthetic Template Oligonucleotide for TCRB Locus
gccttgccagcccgctcagcaagtcacgtgtctacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtgtctacgtcgacagatacgcagtattttggcccaggcacccggctgacagtgctcggtaagcgggggctcccgctgaagccccggaactggggagggggcgccccgggacgccaagtcacgtgtctacctgatggcgcgagggaggc

SEQ ID NO: 1563 - DNA, 495 bp, Artificial Sequence
  Synthetic Template Oligonucleotide for TCRB Locus
gccttgccagcccgctcagcaagtcacgtacagtgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtacagtggtcgacaaaacattcagtacttcggcgccgggacccggctctcagtgctgggtaagctggggccgccgggggaccggggacgagactgcgctcgggtttttgtgcgcaagtcacgtacagtgctgatggcgcgagggaggc

SEQ ID NO: 1564 - DNA, 495 bp, Artificial Sequence
  Synthetic Template Oligonucleotide for TCRB Locus
gccttgccagcccgctcagcaagtcacggatcatcccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacggatcatcgtcgacgagacccagtacttcgggccaggcacgcggctcctggtgctcggtgagcgcgggctgctggggcgcgggcgcgggcggcttgggtctggtttttgcggggcaagtcacggatcatcctgatggcgcgagggaggc

SEQ ID NO: 1565 - DNA, 495 bp, Artificial Sequence
  Synthetic Template Oligonucleotide for TCRB Locus
gccttgccagcccgctcagcaagtcactattggcgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcactattggcggtcgacgggccaacgtcctgactttcggggccggcagcaggctgaccgtgctgggtgagttttcgcgggaccacccgggcggcgggattcaggtggaaggcggcggcaagtcactattggcgctgatggcgcgagggaggc

SEQ ID NO: 1566 - DNA, 495 bp, Artificial Sequence
  Synthetic Template Oligonucleotide for TCRB Locus
gccttgccagcccgctcagcaagtcacaggcttgaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacaggcttgagtcgacacgagcagtacttcgggccgggcaccaggctcacggtcacaggtgagattcgggcgtctccccaccttccagcccctcggtccccggagtcggagggtggcaagtcacaggcttgactgatggcgcgagggaggc

SEQ ID NO: 1567 - DNA, 495 bp, Artificial Sequence
  Synthetic Template Oligonucleotide for TCRB Locus
gccttgccagcccgctcaggatggcttgacactctttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgacactctgtcgacactgaagctttctttggacaaggcaccagactcacagttgtaggtaagacatttttcaggttcttttgcagatccgtcacagggaaaagtgggtccacaggatggcttgacactctctgatggcgcgagggaggc

SEQ ID NO: 1568 - DNA, 495 bp, Artificial Sequence
  Synthetic Template Oligonucleotide for TCRB Locus
gccttgccagcccgctcaggatggcttttcggaacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttttcggaacgtcgactatggctacaccttcggttcggggaccaggttaaccgttgtaggtaaggctgggggtctctaggaggggtgcgatgagggaggactctgtcctgggaaatgatggcttttcggaacctgatggcgcgagggaggc

SEQ ID NO: 1569 - DNA, 495 bp, Artificial Sequence
  Synthetic Template Oligonucleotide for TCRB Locus
gccttgccagcccgctcaggatggcttaagtaacgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttaagtaacggtcgacgaaacaccatatattttggagagggaagttggctcactgttgtaggtgagtaagtcaaggctggacagctgggaacttgcaaaaaggggctggaatccaggatggcttaagtaacgctgatggcgcgagggaggc

SEQ ID NO: 1570 - DNA, 495 bp, Artificial Sequence
  Synthetic Template Oligonucleotide for TCRB Locus
gccttgccagcccgctcaggatggcttgtctcctattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtctcctagtcgacaatgaaaaactgttttttggcagtggaacccagctctctgtcttgggtatgtaaaagacttctttcgggatagtgtatcataaggtcggagttccaggaggatggcttgtctcctactgatggcgcgagggaggc

SEQ ID NO: 1571 - DNA, 495 bp, Artificial Sequence
  Synthetic Template Oligonucleotide for TCRB Locus
gccttgccagcccgctcaggatggcttagagtgtcttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttagagtgtcgtcgacatcagccccagcattttggtgatgggactcgactctccatcctaggtaagttgcagaatcagggtggtatggccattgtcccttgaaggcagagttctctgatggcttagagtgtcctgatggcgcgagggaggc

SEQ ID NO: 1572 - DNA, 495 bp, Artificial Sequence
  Synthetic Template Oligonucleotide for TCRB Locus
gccttgccagcccgctcaggatggcttgttccgaattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgttccgaagtcgacataattcacccctccactttgggaacgggaccaggctcactgtgacaggtatgggggctccactcttgactcgggggtgcctgggtttgactgcaatgatgatggcttgttccgaactgatggcgcgagggaggc

SEQ ID NO: 1573 - DNA, 495 bp, Artificial Sequence
  Synthetic Template Oligonucleotide for TCRB Locus
gccttgccagcccgctcaggatggcttcgttacttttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttcgttacttgtcgacacaatgagcagttcttcgggccagggacacggctcaccgtgctaggtaagaagggggctccaggtgggagagagggtgagcagcccagcctgcacgacccgatggcttcgttacttctgatggcgcgagggaggc

SEQ ID NO: 1574 - DNA, 495 bp, Artificial Sequence
  Synthetic Template Oligonucleotide for TCRB Locus
gccttgccagcccgctcaggatggctttaggagacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggctttaggagacgtcgacaccggggagctgttttttggagaaggctctaggctgaccgtactgggtaaggaggcggttggggctccggagagctccgagagggcgggatgggcagagggatggctttaggagacctgatggcgcgagggaggc

SEQ ID NO: 1575 - DNA, 495 bp, Artificial Sequence
  Synthetic Template Oligonucleotide for TCRB Locus
gccttgccagcccgctcaggatggcttgtgtctacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtgtctacgtcgacagatacgcagtattttggcccaggcacccggctgacagtgctcggtaagcgggggctcccgctgaagccccggaactggggagggggcgccccgggacgcgatggcttgtgtctacctgatggcgcgagggaggc

SEQ ID NO: 1576 - DNA, 495 bp, Artificial Sequence
  Synthetic Template Oligonucleotide for TCRB Locus
gccttgccagcccgctcaggatggcttgtacagtgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtacagtggtcgacaaaacattcagtacttcggcgccgggacccggctctcagtgctgggtaagctggggccgccgggggaccggggacgagactgcgctcgggtttttgtgcggatggcttgtacagtgctgatggcgcgagggaggc

SEQ ID NO: 1577 - DNA, 495 bp, Artificial Sequence
  Synthetic Template Oligonucleotide for TCRB Locus
gccttgccagcccgctcaggatggcttggatcatcttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttggatcatcgtcgacgagacccagtacttcgggccaggcacgcggctcctggtgctcggtgagcgcgggctgctggggcgcgggcgcgggcggcttgggtctggtttttgcgggggatggcttggatcatcctgatggcgcgagggaggc

SEQ ID NO: 1578 - DNA, 495 bp, Artificial Sequence
  Synthetic Template Oligonucleotide for TCRB Locus
gccttgccagcccgctcaggatggctttattggcgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggctttattggcggtcgacgggccaacgtcctgactttcggggccggcagcaggctgaccgtgctgggtgagttttcgcgggaccacccgggcggcgggattcaggtggaaggcggcgggatggctttattggcgctgatggcgcgagggaggc

SEQ ID NO: 1579 - DNA, 495 bp, Artificial Sequence
  Synthetic Template Oligonucleotide for TCRB Locus
gccttgccagcccgctcaggatggcttaggcttgattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttaggcttgagtcgacacgagcagtacttcgggccgggcaccaggctcacggtcacaggtgagattcgggcgtctccccaccttccagcccctcggtccccggagtcggagggtgggatggcttaggcttgactgatggcgcgagggaggc

SEQ ID NO: 1580 - DNA, 495 bp, Artificial Sequence
  Synthetic Template Oligonucleotide for TCRB Locus
gccttgccagcccgctcagctgcaatcgacactctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgacactctgtcgacactgaagctttctttggacaaggcaccagactcacagttgtaggtaagacatttttcaggttcttttgcagatccgtcacagggaaaagtgggtccacagctgcaatcgacactctctgatggcgcgagggaggc

SEQ ID NO: 1581 - DNA, 495 bp, Artificial Sequence
  Synthetic Template Oligonucleotide for TCRB Locus
gccttgccagcccgctcagctgcaatcttcggaacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcttcggaacgtcgactatggctacaccttcggttcggggaccaggttaaccgttgtaggtaaggctgggggtctctaggaggggtgcgatgagggaggactctgtcctgggaaatctgcaatcttcggaacctgatggcgcgagggaggc

SEQ ID NO: 1582 - DNA, 495 bp, Artificial Sequence
  Synthetic Template Oligonucleotide for TCRB Locus
gccttgccagcccgctcagctgcaatcaagtaacggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcaagtaacggtcgacgaaacaccatatattttggagagggaagttggctcactgttgtaggtgagtaagtcaaggctggacagctgggaacttgcaaaaaggggctggaatccagctgcaatcaagtaacgctgatggcgcgagggaggc

SEQ ID NO: 1583 - DNA, 495 bp, Artificial Sequence
  Synthetic Template Oligonucleotide for TCRB Locus
gccttgccagcccgctcagctgcaatcgtctcctagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtctcctagtcgacaatgaaaaactgttttttggcagtggaacccagctctctgtcttgggtatgtaaaagacttctttcgggatagtgtatcataaggtcggagttccaggagctgcaatcgtctcctactgatggcgcgagggaggc

SEQ ID NO: 1584 - DNA, 495 bp, Artificial Sequence
  Synthetic Template Oligonucleotide for TCRB Locus
gccttgccagcccgctcagctgcaatcagagtgtcgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcagagtgtcgtcgacatcagccccagcattttggtgatgggactcgactctccatcctaggtaagttgcagaatcagggtggtatggccattgtcccttgaaggcagagttctctctgcaatcagagtgtcctgatggcgcgagggaggc

SEQ ID NO: 1585 - DNA, 495 bp, Artificial Sequence
  Synthetic Template Oligonucleotide for TCRB Locus
gccttgccagcccgctcagctgcaatcgttccgaagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgttccgaagtcgacataattcacccctccactttgggaacgggaccaggctcactgtgacaggtatgggggctccactcttgactcgggggtgcctgggtttgactgcaatgatctgcaatcgttccgaactgatggcgcgagggaggc

SEQ ID NO: 1586 - DNA, 495 bp, Artificial Sequence
  Synthetic Template Oligonucleotide for TCRB Locus
gccttgccagcccgctcagctgcaatccgttacttgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatccgttacttgtcgacacaatgagcagttcttcgggccagggacacggctcaccgtgctaggtaagaagggggctccaggtgggagagagggtgagcagcccagcctgcacgacccctgcaatccgttacttctgatggcgcgagggaggc

SEQ ID NO: 1587 - DNA, 495 bp, Artificial Sequence
  Synthetic Template Oligonucleotide for TCRB Locus
gccttgccagcccgctcagctgcaatctaggagacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatctaggagacgtcgacaccggggagctgttttttggagaaggctctaggctgaccgtactgggtaaggaggcggttggggctccggagagctccgagagggcgggatgggcagaggctgcaatctaggagacctgatggcgcgagggaggc

SEQ ID NO: 1588 - DNA, 495 bp, Artificial Sequence
  Synthetic Template Oligonucleotide for TCRB Locus
gccttgccagcccgctcagctgcaatcgtgtctacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtgtctacgtcgacagatacgcagtattttggcccaggcacccggctgacagtgctcggtaagcgggggctcccgctgaagccccggaactggggagggggcgccccgggacgcctgcaatcgtgtctacctgatggcgcgagggaggc

SEQ ID NO: 1589 - DNA, 495 bp, Artificial Sequence
  Synthetic Template Oligonucleotide for TCRB Locus
gccttgccagcccgctcagctgcaatcgtacagtggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtacagtggtcgacaaaacattcagtacttcggcgccgggacccggctctcagtgctgggtaagctggggccgccgggggaccggggacgagactgcgctcgggtttttgtgcgctgcaatcgtacagtgctgatggcgcgagggaggc

SEQ ID NO: 1590 - DNA, 495 bp, Artificial Sequence
  Synthetic Template Oligonucleotide for TCRB Locus
gccttgccagcccgctcagctgcaatcggatcatcgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcggatcatcgtcgacgagacccagtacttcgggccaggcacgcggctcctggtgctcggtgagcgcgggctgctggggcgcgggcgcgggcggcttgggtctggtttttgcggggctgcaatcggatcatcctgatggcgcgagggaggc

SEQ ID NO: 1591 - DNA, 495 bp, Artificial Sequence
  Synthetic Template Oligonucleotide for TCRB Locus
gccttgccagcccgctcagctgcaatctattggcggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatctattggcggtcgacgggccaacgtcctgactttcggggccggcagcaggctgaccgtgctgggtgagttttcgcgggaccacccgggcggcgggattcaggtggaaggcggcggctgcaatctattggcgctgatggcgcgagggaggc

SEQ ID NO: 1592 - DNA, 495 bp, Artificial Sequence
  Synthetic Template Oligonucleotide for TCRB Locus
gccttgccagcccgctcagctgcaatcaggcttgagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcaggcttgagtcgacacgagcagtacttcgggccgggcaccaggctcacggtcacaggtgagattcgggcgtctccccaccttccagcccctcggtccccggagtcggagggtggctgcaatcaggcttgactgatggcgcgagggaggc

SEQ ID NO: 1593 - DNA, 495 bp, Artificial Sequence
  Synthetic Template Oligonucleotide for TCRB Locus
gccttgccagcccgctcaggtcatagtgacactctactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgacactctgtcgacactgaagctttctttggacaaggcaccagactcacagttgtaggtaagacatttttcaggttcttttgcagatccgtcacagggaaaagtgggtccacaggtcatagtgacactctctgatggcgcgagggaggc

SEQ ID NO: 1594 - DNA, 495 bp, Artificial Sequence
  Synthetic Template Oligonucleotide for TCRB Locus
gccttgccagcccgctcaggtcatagtttcggaacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtttcggaacgtcgactatggctacaccttcggttcggggaccaggttaaccgttgtaggtaaggctgggggtctctaggaggggtgcgatgagggaggactctgtcctgggaaatgtcatagtttcggaacctgatggcgcgagggaggc

SEQ ID NO: 1595 - DNA, 495 bp, Artificial Sequence
  Synthetic Template Oligonucleotide for TCRB Locus
gccttgccagcccgctcaggtcatagtaagtaacgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtaagtaacggtcgacgaaacaccatatattttggagagggaagttggctcactgttgtaggtgagtaagtcaaggctggacagctgggaacttgcaaaaaggggctggaatccaggtcatagtaagtaacgctgatggcgcgagggaggc

SEQ ID NO: 1596 - DNA, 495 bp, Artificial Sequence
  Synthetic Template Oligonucleotide for TCRB Locus
gccttgccagcccgctcaggtcatagtgtctcctaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtctcctagtcgacaatgaaaaactgttttttggcagtggaacccagctctctgtcttgggtatgtaaaagacttctttcgggatagtgtatcataaggtcggagttccaggaggtcatagtgtctcctactgatggcgcgagggaggc

SEQ ID NO: 1597 - DNA, 495 bp, Artificial Sequence
  Synthetic Template Oligonucleotide for TCRB Locus
gccttgccagcccgctcaggtcatagtagagtgtcactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtagagtgtcgtcgacatcagccccagcattttggtgatgggactcgactctccatcctaggtaagttgcagaatcagggtggtatggccattgtcccttgaaggcagagttctctgtcatagtagagtgtcctgatggcgcgagggaggc

SEQ ID NO: 1598 - DNA, 495 bp, Artificial Sequence
  Synthetic Template Oligonucleotide for TCRB Locus
gccttgccagcccgctcaggtcatagtgttccgaaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgttccgaagtcgacataattcacccctccactttgggaacgggaccaggctcactgtgacaggtatgggggctccactcttgactcgggggtgcctgggtttgactgcaatgatgtcatagtgttccgaactgatggcgcgagggaggc

SEQ ID NO: 1599 - DNA, 495 bp, Artificial Sequence
  Synthetic Template Oligonucleotide for TCRB Locus
gccttgccagcccgctcaggtcatagtcgttacttactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtcgttacttgtcgacacaatgagcagttcttcgggccagggacacggctcaccgtgctaggtaagaagggggctccaggtgggagagagggtgagcagcccagcctgcacgacccgtcatagtcgttacttctgatggcgcgagggaggc

SEQ ID NO: 1600 - DNA, 495 bp, Artificial Sequence
  Synthetic Template Oligonucleotide for TCRB Locus
gccttgccagcccgctcaggtcatagttaggagacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagttaggagacgtcgacaccggggagctgttttttggagaaggctctaggctgaccgtactgggtaaggaggcggttggggctccggagagctccgagagggcgggatgggcagagggtcatagttaggagacctgatggcgcgagggaggc

SEQ ID NO: 1601 - DNA, 495 bp, Artificial Sequence
  Synthetic Template Oligonucleotide for TCRB Locus
gccttgccagcccgctcaggtcatagtgtgtctacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtgtctacgtcgacagatacgcagtattttggcccaggcacccggctgacagtgctcggtaagcgggggctcccgctgaagccccggaactggggagggggcgccccgggacgcgtcatagtgtgtctacctgatggcgcgagggaggc

SEQ ID NO: 1602 - DNA, 495 bp, Artificial Sequence
  Synthetic Template Oligonucleotide for TCRB Locus
gccttgccagcccgctcaggtcatagtgtacagtgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtacagtggtcgacaaaacattcagtacttcggcgccgggacccggctctcagtgctgggtaagctggggccgccgggggaccggggacgagactgcgctcgggtttttgtgcggtcatagtgtacagtgctgatggcgcgagggaggc

SEQ ID NO: 1603 - DNA, 495 bp, Artificial Sequence
  Synthetic Template Oligonucleotide for TCRB Locus
gccttgccagcccgctcaggtcatagtggatcatcactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtggatcatcgtcgacgagacccagtacttcgggccaggcacgcggctcctggtgctcggtgagcgcgggctgctggggcgcgggcgcgggcggcttgggtctggtttttgcgggggtcatagtggatcatcctgatggcgcgagggaggc

SEQ ID NO: 1604 - DNA, 495 bp, Artificial Sequence
  Synthetic Template Oligonucleotide for TCRB Locus
gccttgccagcccgctcaggtcatagttattggcgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagttattggcggtcgacgggccaacgtcctgactttcggggccggcagcaggctgaccgtgctgggtgagttttcgcgggaccacccgggcggcgggattcaggtggaaggcggcgggtcatagttattggcgctgatggcgcgagggaggc

SEQ ID NO: 1605 - DNA, 495 bp, Artificial Sequence
  Synthetic Template Oligonucleotide for TCRB Locus
gccttgccagcccgctcaggtcatagtaggcttgaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtaggcttgagtcgacacgagcagtacttcgggccgggcaccaggctcacggtcacaggtgagattcgggcgtctccccaccttccagcccctcggtccccggagtcggagggtgggtcatagtaggcttgactgatggcgcgagggaggc

SEQ ID NO: 1606 - DNA, 495 bp, Artificial Sequence
  Synthetic Template Oligonucleotide for TCRB Locus
gccttgccagcccgctcagcacatggagacactcttatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagacactctgtcgacactgaagctttctttggacaaggcaccagactcacagttgtaggtaagacatttttcaggttcttttgcagatccgtcacagggaaaagtgggtccacagcacatggagacactctctgatggcgcgagggaggc

SEQ ID NO: 1607 - DNA, 495 bp, Artificial Sequence
  Synthetic Template Oligonucleotide for TCRB Locus
gccttgccagcccgctcagcacatggattcggaactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggattcggaacgtcgactatggctacaccttcggttcggggaccaggttaaccgttgtaggtaaggctgggggtctctaggaggggtgcgatgagggaggactctgtcctgggaaatcacatggattcggaacctgatggcgcgagggaggc

SEQ ID NO: 1608 - DNA, 495 bp, Artificial Sequence
  Synthetic Template Oligonucleotide for TCRB Locus
gccttgccagcccgctcagcacatggaaagtaacgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaaagtaacggtcgacgaaacaccatatattttggagagggaagttggctcactgttgtaggtgagtaagtcaaggctggacagctgggaacttgcaaaaaggggctggaatccagcacatggaaagtaacgctgatggcgcgagggaggc

SEQ ID NO: 1609 - DNA, 495 bp, Artificial Sequence
  Synthetic Template Oligonucleotide for TCRB Locus
gccttgccagcccgctcagcacatggagtctcctatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtctcctagtcgacaatgaaaaactgttttttggcagtggaacccagctctctgtcttgggtatgtaaaagacttctttcgggatagtgtatcataaggtcggagttccaggagcacatggagtctcctactgatggcgcgagggaggc

SEQ ID NO: 1610 - DNA, 495 bp, Artificial Sequence
  Synthetic Template Oligonucleotide for TCRB Locus
gccttgccagcccgctcagcacatggaagagtgtctatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaagagtgtcgtcgacatcagccccagcattttggtgatgggactcgactctccatcctaggtaagttgcagaatcagggtggtatggccattgtcccttgaaggcagagttctctcacatggaagagtgtcctgatggcgcgagggaggc

SEQ ID NO: 1611 - DNA, 495 bp, Artificial Sequence
  Synthetic Template Oligonucleotide for TCRB Locus
gccttgccagcccgctcagcacatggagttccgaatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagttccgaagtcgacataattcacccctccactttgggaacgggaccaggctcactgtgacaggtatgggggctccactcttgactcgggggtgcctgggtttgactgcaatgatcacatggagttccgaactgatggcgcgagggaggc

SEQ ID NO: 1612 - DNA, 495 bp, Artificial Sequence
  Synthetic Template Oligonucleotide for TCRB Locus
gccttgccagcccgctcagcacatggacgttactttatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggacgttacttgtcgacacaatgagcagttcttcgggccagggacacggctcaccgtgctaggtaagaagggggctccaggtgggagagagggtgagcagcccagcctgcacgaccccacatggacgttacttctgatggcgcgagggaggc

SEQ ID NO: 1613 - DNA, 495 bp, Artificial Sequence
  Synthetic Template Oligonucleotide for TCRB Locus
gccttgccagcccgctcagcacatggataggagactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggataggagacgtcgacaccggggagctgttttttggagaaggctctaggctgaccgtactgggtaaggaggcggttggggctccggagagctccgagagggcgggatgggcagaggcacatggataggagacctgatggcgcgagggaggc

SEQ ID NO: 1614 - DNA, 495 bp, Artificial Sequence
  Synthetic Template Oligonucleotide for TCRB Locus
gccttgccagcccgctcagcacatggagtgtctactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtgtctacgtcgacagatacgcagtattttggcccaggcacccggctgacagtgctcggtaagcgggggctcccgctgaagccccggaactggggagggggcgccccgggacgccacatggagtgtctacctgatggcgcgagggaggc

SEQ ID NO: 1615 - DNA, 495 bp, Artificial Sequence
  Synthetic Template Oligonucleotide for TCRB Locus
gccttgccagcccgctcagcacatggagtacagtgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtacagtggtcgacaaaacattcagtacttcggcgccgggacccggctctcagtgctgggtaagctggggccgccgggggaccggggacgagactgcgctcgggtttttgtgcgcacatggagtacagtgctgatggcgcgagggaggc

SEQ ID NO: 1616 - DNA, 495 bp, Artificial Sequence
  Synthetic Template Oligonucleotide for TCRB Locus
gccttgccagcccgctcagcacatggaggatcatctatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaggatcatcgtcgacgagacccagtacttcgggccaggcacgcggctcctggtgctcggtgagcgcgggctgctggggcgcgggcgcgggcggcttgggtctggtttttgcggggcacatggaggatcatcctgatggcgcgagggaggc

SEQ ID NO: 1617 - DNA, 495 bp, Artificial Sequence
  Synthetic Template Oligonucleotide for TCRB Locus
gccttgccagcccgctcagcacatggatattggcgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggatattggcggtcgacgggccaacgtcctgactttcggggccggcagcaggctgaccgtgctgggtgagttttcgcgggaccacccgggcggcgggattcaggtggaaggcggcggcacatggatattggcgctgatggcgcgagggaggc

SEQ ID NO: 1618 - DNA, 495 bp, Artificial Sequence
  Synthetic Template Oligonucleotide for TCRB Locus
gccttgccagcccgctcagcacatggaaggcttgatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaaggcttgagtcgacacgagcagtacttcgggccgggcaccaggctcacggtcacaggtgagattcgggcgtctccccaccttccagcccctcggtccccggagtcggagggtggcacatggaaggcttgactgatggcgcgagggaggc

SEQ ID NO: 1619 - DNA, 495 bp, Artificial Sequence
  Synthetic Template Oligonucleotide for TCRB Locus
gccttgccagcccgctcagttgaccatgacactcttctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgacactctgtcgacactgaagctttctttggacaaggcaccagactcacagttgtaggtaagacatttttcaggttcttttgcagatccgtcacagggaaaagtgggtccacagttgaccatgacactctctgatggcgcgagggaggc

SEQ ID NO: 1620 - DNA, 495 bp, Artificial Sequence
  Synthetic Template Oligonucleotide for TCRB Locus
gccttgccagcccgctcagttgaccatttcggaactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatttcggaacgtcgactatggctacaccttcggttcggggaccaggttaaccgttgtaggtaaggctgggggtctctaggaggggtgcgatgagggaggactctgtcctgggaaatttgaccatttcggaacctgatggcgcgagggaggc

SEQ ID NO: 1621 - DNA, 495 bp, Artificial Sequence
  Synthetic Template Oligonucleotide for TCRB Locus
gccttgccagcccgctcagttgaccataagtaacgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccataagtaacggtcgacgaaacaccatatattttggagagggaagttggctcactgttgtaggtgagtaagtcaaggctggacagctgggaacttgcaaaaaggggctggaatccagttgaccataagtaacgctgatggcgcgagggaggc

SEQ ID NO: 1622 - DNA, 495 bp, Artificial Sequence
  Synthetic Template Oligonucleotide for TCRB Locus
gccttgccagcccgctcagttgaccatgtctcctatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtctcctagtcgacaatgaaaaactgttttttggcagtggaacccagctctctgtcttgggtatgtaaaagacttctttcgggatagtgtatcataaggtcggagttccaggagttgaccatgtctcctactgatggcgcgagggaggc

SEQ ID NO: 1623 - DNA, 495 bp, Artificial Sequence
  Synthetic Template Oligonucleotide for TCRB Locus
gccttgccagcccgctcagttgaccatagagtgtctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatagagtgtcgtcgacatcagccccagcattttggtgatgggactcgactctccatcctaggtaagttgcagaatcagggtggtatggccattgtcccttgaaggcagagttctctttgaccatagagtgtcctgatggcgcgagggaggc

SEQ ID NO: 1624 - DNA, 495 bp, Artificial Sequence
  Synthetic Template Oligonucleotide for TCRB Locus
gccttgccagcccgctcagttgaccatgttccgaatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgttccgaagtcgacataattcacccctccactttgggaacgggaccaggctcactgtgacaggtatgggggctccactcttgactcgggggtgcctgggtttgactgcaatgatttgaccatgttccgaactgatggcgcgagggaggc

SEQ ID NO: 1625 - DNA, 495 bp, Artificial Sequence
  Synthetic Template Oligonucleotide for TCRB Locus
gccttgccagcccgctcagttgaccatcgttactttctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatcgttacttgtcgacacaatgagcagttcttcgggccagggacacggctcaccgtgctaggtaagaagggggctccaggtgggagagagggtgagcagcccagcctgcacgacccttgaccatcgttacttctgatggcgcgagggaggc

SEQ ID NO: 1626 - DNA, 495 bp, Artificial Sequence
  Synthetic Template Oligonucleotide for TCRB Locus
gccttgccagcccgctcagttgaccattaggagactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccattaggagacgtcgacaccggggagctgttttttggagaaggctctaggctgaccgtactgggtaaggaggcggttggggctccggagagctccgagagggcgggatgggcagaggttgaccattaggagacctgatggcgcgagggaggc

SEQ ID NO: 1627 - DNA, 495 bp, Artificial Sequence
  Synthetic Template Oligonucleotide for TCRB Locus
gccttgccagcccgctcagttgaccatgtgtctactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtgtctacgtcgacagatacgcagtattttggcccaggcacccggctgacagtgctcggtaagcgggggctcccgctgaagccccggaactggggagggggcgccccgggacgcttgaccatgtgtctacctgatggcgcgagggaggc

SEQ ID NO: 1628 - DNA, 495 bp, Artificial Sequence
  Synthetic Template Oligonucleotide for TCRB Locus
gccttgccagcccgctcagttgaccatgtacagtgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtacagtggtcgacaaaacattcagtacttcggcgccgggacccggctctcagtgctgggtaagctggggccgccgggggaccggggacgagactgcgctcgggtttttgtgcgttgaccatgtacagtgctgatggcgcgagggaggc

SEQ ID NO: 1629 - DNA, 495 bp, Artificial Sequence
  Synthetic Template Oligonucleotide for TCRB Locus
gccttgccagcccgctcagttgaccatggatcatctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatggatcatcgtcgacgagacccagtacttcgggccaggcacgcggctcctggtgctcggtgagcgcgggctgctggggcgcgggcgcgggcggcttgggtctggtttttgcggggttgaccatggatcatcctgatggcgcgagggaggc

SEQ ID NO: 1630 - DNA, 495 bp, Artificial Sequence
  Synthetic Template Oligonucleotide for TCRB Locus
gccttgccagcccgctcagttgaccattattggcgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccattattggcggtcgacgggccaacgtcctgactttcggggccggcagcaggctgaccgtgctgggtgagttttcgcgggaccacccgggcggcgggattcaggtggaaggcggcggttgaccattattggcgctgatggcgcgagggaggc

SEQ ID NO: 1631 - DNA, 495 bp, Artificial Sequence
  Synthetic Template Oligonucleotide for TCRB Locus
gccttgccagcccgctcagttgaccataggcttgatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccataggcttgagtcgacacgagcagtacttcgggccgggcaccaggctcacggtcacaggtgagattcgggcgtctccccaccttccagcccctcggtccccggagtcggagggtggttgaccataggcttgactgatggcgcgagggaggc

SEQ ID NO: 1632 - DNA, 495 bp, Artificial Sequence
  Synthetic Template Oligonucleotide for TCRB Locus
gccttgccagcccgctcaggtgacttggacactctcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggacactctgtcgacactgaagctttctttggacaaggcaccagactcacagttgtaggtaagacatttttcaggttcttttgcagatccgtcacagggaaaagtgggtccacaggtgacttggacactctctgatggcgcgagggaggc

SEQ ID NO: 1633 - DNA, 495 bp, Artificial Sequence
  Synthetic Template Oligonucleotide for TCRB Locus
gccttgccagcccgctcaggtgacttgttcggaaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgttcggaacgtcgactatggctacaccttcggttcggggaccaggttaaccgttgtaggtaaggctgggggtctctaggaggggtgcgatgagggaggactctgtcctgggaaatgtgacttgttcggaacctgatggcgcgagggaggc

SEQ ID NO: 1634 - DNA, 495 bp, Artificial Sequence
  Synthetic Template Oligonucleotide for TCRB Locus
gccttgccagcccgctcaggtgacttgaagtaacgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgaagtaacggtcgacgaaacaccatatattttggagagggaagttggctcactgttgtaggtgagtaagtcaaggctggacagctgggaacttgcaaaaaggggctggaatccaggtgacttgaagtaacgctgatggcgcgagggaggc

SEQ ID NO: 1635 - DNA, 495 bp, Artificial Sequence
  Synthetic Template Oligonucleotide for TCRB Locus
gccttgccagcccgctcaggtgacttggtctcctacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtctcctagtcgacaatgaaaaactgttttttggcagtggaacccagctctctgtcttgggtatgtaaaagacttctttcgggatagtgtatcataaggtcggagttccaggaggtgacttggtctcctactgatggcgcgagggaggc

SEQ ID NO: 1636 - DNA, 495 bp, Artificial Sequence
  Synthetic Template Oligonucleotide for TCRB Locus
gccttgccagcccgctcaggtgacttgagagtgtccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgagagtgtcgtcgacatcagccccagcattttggtgatgggactcgactctccatcctaggtaagttgcagaatcagggtggtatggccattgtcccttgaaggcagagttctctgtgacttgagagtgtcctgatggcgcgagggaggc

SEQ ID NO: 1637 - DNA, 495 bp, Artificial Sequence
  Synthetic Template Oligonucleotide for TCRB Locus
gccttgccagcccgctcaggtgacttggttccgaacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggttccgaagtcgacataattcacccctccactttgggaacgggaccaggctcactgtgacaggtatgggggctccactcttgactcgggggtgcctgggtttgactgcaatgatgtgacttggttccgaactgatggcgcgagggaggc

SEQ ID NO: 1638 - DNA, 495 bp, Artificial Sequence
  Synthetic Template Oligonucleotide for TCRB Locus
gccttgccagcccgctcaggtgacttgcgttacttcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgcgttacttgtcgacacaatgagcagttcttcgggccagggacacggctcaccgtgctaggtaagaagggggctccaggtgggagagagggtgagcagcccagcctgcacgacccgtgacttgcgttacttctgatggcgcgagggaggc

SEQ ID NO: 1639 - DNA, 495 bp, Artificial Sequence
  Synthetic Template Oligonucleotide for TCRB Locus
gccttgccagcccgctcaggtgacttgtaggagaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgtaggagacgtcgacaccggggagctgttttttggagaaggctctaggctgaccgtactgggtaaggaggcggttggggctccggagagctccgagagggcgggatgggcagagggtgacttgtaggagacctgatggcgcgagggaggc

SEQ ID NO: 1640 - DNA, 495 bp, Artificial Sequence
  Synthetic Template Oligonucleotide for TCRB Locus
gccttgccagcccgctcaggtgacttggtgtctaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtgtctacgtcgacagatacgcagtattttggcccaggcacccggctgacagtgctcggtaagcgggggctcccgctgaagccccggaactggggagggggcgccccgggacgcgtgacttggtgtctacctgatggcgcgagggaggc

SEQ ID NO: 1641 - DNA, 495 bp, Artificial Sequence
  Synthetic Template Oligonucleotide for TCRB Locus
gccttgccagcccgctcaggtgacttggtacagtgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtacagtggtcgacaaaacattcagtacttcggcgccgggacccggctctcagtgctgggtaagctggggccgccgggggaccggggacgagactgcgctcgggtttttgtgcggtgacttggtacagtgctgatggcgcgagggaggc

SEQ ID NO: 1642 - DNA, 495 bp, Artificial Sequence
  Synthetic Template Oligonucleotide for TCRB Locus
gccttgccagcccgctcaggtgacttgggatcatccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgggatcatcgtcgacgagacccagtacttcgggccaggcacgcggctcctggtgctcggtgagcgcgggctgctggggcgcgggcgcgggcggcttgggtctggtttttgcgggggtgacttgggatcatcctgatggcgcgagggaggc

SEQ ID NO: 1643 - DNA, 495 bp, Artificial Sequence
  Synthetic Template Oligonucleotide for TCRB Locus
gccttgccagcccgctcaggtgacttgtattggcgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgtattggcggtcgacgggccaacgtcctgactttcggggccggcagcaggctgaccgtgctgggtgagttttcgcgggaccacccgggcggcgggattcaggtggaaggcggcgggtgacttgtattggcgctgatggcgcgagggaggc

SEQ ID NO: 1644 - DNA, 495 bp, Artificial Sequence
  Synthetic Template Oligonucleotide for TCRB Locus
gccttgccagcccgctcaggtgacttgaggcttgacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgaggcttgagtcgacacgagcagtacttcgggccgggcaccaggctcacggtcacaggtgagattcgggcgtctccccaccttccagcccctcggtccccggagtcggagggtgggtgacttgaggcttgactgatggcgcgagggaggc

SEQ ID NO: 1645 - DNA, 382 bp, Artificial Sequence
  Synthetic Template Oligonucleotide for IgH DJ Locus
gccttgccagcccgctcaggacactctgtacagtggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctgtacagtggtcgacatacttccagcactggggccagggcaccctggtcaccgtctcctcaggtgagtctgctgtctggggatagcggggagccaggtgtactgggccaggcaaggacactctgtacagtgctgatggcgcgagggaggc

SEQ ID NO: 1646 - DNA, 382 bp, Artificial Sequence
  Synthetic Template Oligonucleotide for IgH DJ Locus
gccttgccagcccgctcagttcggaacgtacagtgggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacgtacagtggtcgacatacttccagcactggggccagggcaccctggtcaccgtctcctcaggtgagtctgctgtctggggatagcggggagccaggtgtactgggccaggcaagttcggaacgtacagtgctgatggcgcgagggaggc

SEQ ID NO: 1647 - DNA, 382 bp, Artificial Sequence
  Synthetic Template Oligonucleotide for IgH DJ Locus
gccttgccagcccgctcagaagtaacggtacagtgggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacggtacagtggtcgacatacttccagcactggggccagggcaccctggtcaccgtctcctcaggtgagtctgctgtctggggatagcggggagccaggtgtactgggccaggcaagaagtaacggtacagtgctgatggcgcgagggaggc

SEQ ID NO: 1648 - DNA, 382 bp, Artificial Sequence
  Synthetic Template Oligonucleotide for IgH DJ Locus
gccttgccagcccgctcaggtctcctagtacagtggtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctagtacagtggtcgacatacttccagcactggggccagggcaccctggtcaccgtctcctcaggtgagtctgctgtctggggatagcggggagccaggtgtactgggccaggcaaggtctcctagtacagtgctgatggcgcgagggaggc

SEQ ID NO: 1649 - DNA, 385 bp, Artificial Sequence
  Synthetic Template Oligonucleotide for IgH DJ Locus
gccttgccagcccgctcagagagtgtcgtacagtgaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcgtacagtggtcgacatacttccagcactggggccagggcaccctggtcaccgtctcctcaggtgagtctgctgtctggggatagcggggagccaggtgtactgggccaggcaagagagtgtcgtacagtgctgatggcgcgagggaggc

SEQ ID NO: 1650 - DNA, 396 bp, Artificial Sequence
  Synthetic Template Oligonucleotide for IgH DJ Locus
gccttgccagcccgctcaggttccgaagtacagtgaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaagtacagtggtcgacatacttccagcactggggccagggcaccctggtcaccgtctcctcaggtgagtctgctgtctggggatagcggggagccaggtgtactgggccaggcaaggttccgaagtacagtgctgatggcgcgagggaggc

SEQ ID NO: 1651 - DNA, 396 bp, Artificial Sequence
  Synthetic Template Oligonucleotide for IgH DJ Locus
gccttgccagcccgctcagcgttacttgtacagtgaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttgtacagtggtcgacatacttccagcactggggccagggcaccctggtcaccgtctcctcaggtgagtctgctgtctggggatagcggggagccaggtgtactgggccaggcaagcgttacttgtacagtgctgatggcgcgagggaggc

SEQ ID NO: 1652 - DNA, 396 bp, Artificial Sequence
  Synthetic Template Oligonucleotide for IgH DJ Locus
gccttgccagcccgctcagtaggagacgtacagtgaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacgtacagtggtcgacatacttccagcactggggccagggcaccctggtcaccgtctcctcaggtgagtctgctgtctggggatagcggggagccaggtgtactgggccaggcaagtaggagacgtacagtgctgatggcgcgagggaggc

SEQ ID NO: 1653 - DNA, 393 bp, Artificial Sequence
  Synthetic Template Oligonucleotide for IgH DJ Locus
gccttgccagcccgctcaggtgtctacgtacagtgagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacgtacagtggtcgacatacttccagcactggggccagggcaccctggtcaccgtctcctcaggtgagtctgctgtctggggatagcggggagccaggtgtactgggccaggcaaggtgtctacgtacagtgctgatggcgcgagggaggc

SEQ ID NO: 1654 - DNA, 396 bp, Artificial Sequence
  Synthetic Template Oligonucleotide for IgH DJ Locus
gccttgccagcccgctcagtgctacacgtacagtggtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacgtacagtggtcgacatacttccagcactggggccagggcaccctggtcaccgtctcctcaggtgagtctgctgtctggggatagcggggagccaggtgtactgggccaggcaagtgctacacgtacagtgctgatggcgcgagggaggc

SEQ ID NO: 1655 - DNA, 396 bp, Artificial Sequence
  Synthetic Template Oligonucleotide for IgH DJ Locus
gccttgccagcccgctcagaactgccagtacagtgtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccagtacagtggtcgacatacttccagcactggggccagggcaccctggtcaccgtctcctcaggtgagtctgctgtctggggatagcggggagccaggtgtactgggccaggcaagaactgccagtacagtgctgatggcgcgagggaggc

SEQ ID NO: 1656 - DNA, 396 bp, Artificial Sequence
  Synthetic Template Oligonucleotide for IgH DJ Locus
gccttgccagcccgctcagttggactggtacagtgcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactggtacagtggtcgacatacttccagcactggggccagggcaccctggtcaccgtctcctcaggtgagtctgctgtctggggatagcggggagccaggtgtactgggccaggcaagttggactggtacagtgctgatggcgcgagggaggc

SEQ ID NO: 1657 - DNA, 402 bp, Artificial Sequence
  Synthetic Template Oligonucleotide for IgH DJ Locus
gccttgccagcccgctcaggtagacacgtacagtgtggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacgtacagtggtcgacatacttccagcactggggccagggcaccctggtcaccgtctcctcaggtgagtctgctgtctggggatagcggggagccaggtgtactgggccaggcaaggtagacacgtacagtgctgatggcgcgagggaggc

SEQ ID NO: 1658 - DNA, 396 bp, Artificial Sequence
  Synthetic Template Oligonucleotide for IgH DJ Locus
gccttgccagcccgctcagcactgtacgtacagtgtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacgtacagtggtcgacatacttccagcactggggccagggcaccctggtcaccgtctcctcaggtgagtctgctgtctggggatagcggggagccaggtgtactgggccaggcaagcactgtacgtacagtgctgatggcgcgagggaggc

SEQ ID NO: 1659 - DNA, 381 bp, Artificial Sequence
  Synthetic Template Oligonucleotide for IgH DJ Locus
gccttgccagcccgctcaggatgatccgtacagtgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccgtacagtggtcgacatacttccagcactggggccagggcaccctggtcaccgtctcctcaggtgagtctgctgtctggggatagcggggagccaggtgtactgggccaggcaaggatgatccgtacagtgctgatggcgcgagggaggc

SEQ ID NO: 1660 - DNA, 381 bp, Artificial Sequence
  Synthetic Template Oligonucleotide for IgH DJ Locus
gccttgccagcccgctcagcgccaatagtacagtgtgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatagtacagtggtcgacatacttccagcactggggccagggcaccctggtcaccgtctcctcaggtgagtctgctgtctggggatagcggggagccaggtgtactgggccaggcaagcgccaatagtacagtgctgatggcgcgagggaggc

SEQ ID NO: 1661 - DNA, 381 bp, Artificial Sequence
  Synthetic Template Oligonucleotide for IgH DJ Locus
gccttgccagcccgctcagtcaagcctgtacagtgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctgtacagtggtcgacatacttccagcactggggccagggcaccctggtcaccgtctcctcaggtgagtctgctgtctggggatagcggggagccaggtgtactgggccaggcaagtcaagcctgtacagtgctgatggcgcgagggaggc

SEQ ID NO: 1662 - DNA, 384 bp, Artificial Sequence
  Synthetic Template Oligonucleotide for IgH DJ Locus
gccttgccagcccgctcagacgtgtgtgtacagtgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtgtacagtggtcgacatacttccagcactggggccagggcaccctggtcaccgtctcctcaggtgagtctgctgtctggggatagcggggagccaggtgtactgggccaggcaagacgtgtgtgtacagtgctgatggcgcgagggaggc

SEQ ID NO: 1663 - DNA, 385 bp, Artificial Sequence
  Synthetic Template Oligonucleotide for IgH DJ Locus
gccttgccagcccgctcagtccgtctagtacagtgagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctagtacagtggtcgacatacttccagcactggggccagggcaccctggtcaccgtctcctcaggtgagtctgctgtctggggatagcggggagccaggtgtactgggccaggcaagtccgtctagtacagtgctgatggcgcgagggaggc

SEQ ID NO: 1664 - DNA, 388 bp, Artificial Sequence
  Synthetic Template Oligonucleotide for IgH DJ Locus
gccttgccagcccgctcagaagagctggtacagtggcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctggtacagtggtcgacatacttccagcactggggccagggcaccctggtcaccgtctcctcaggtgagtctgctgtctggggatagcggggagccaggtgtactgggccaggcaagaagagctggtacagtgctgatggcgcgagggaggc

SEQ ID NO: 1665 - DNA, 385 bp, Artificial Sequence
  Synthetic Template Oligonucleotide for IgH DJ Locus
gccttgccagcccgctcagtatcgctcgtacagtggcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcgtacagtggtcgacatacttccagcactggggccagggcaccctggtcaccgtctcctcaggtgagtctgctgtctggggatagcggggagccaggtgtactgggccaggcaagtatcgctcgtacagtgctgatggcgcgagggaggc

SEQ ID NO: 1666 - DNA, 385 bp, Artificial Sequence
  Synthetic Template Oligonucleotide for IgH DJ Locus
gccttgccagcccgctcagtcagatgcgtacagtggcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcgtacagtggtcgacatacttccagcactggggccagggcaccctggtcaccgtctcctcaggtgagtctgctgtctggggatagcggggagccaggtgtactgggccaggcaagtcagatgcgtacagtgctgatggcgcgagggaggc

SEQ ID NO: 1667 - DNA, 383 bp, Artificial Sequence
  Synthetic Template Oligonucleotide for IgH DJ Locus
gccttgccagcccgctcaggtgtagcagtacagtgaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcagtacagtggtcgacatacttccagcactggggccagggcaccctggtcaccgtctcctcaggtgagtctgctgtctggggatagcggggagccaggtgtactgggccaggcaaggtgtagcagtacagtgctgatggcgcgagggaggc

SEQ ID NO: 1668 - DNA, 386 bp, Artificial Sequence
  Synthetic Template Oligonucleotide for IgH DJ Locus
gccttgccagcccgctcagtggcagttgtacagtgaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttgtacagtggtcgacatacttccagcactggggccagggcaccctggtcaccgtctcctcaggtgagtctgctgtctggggatagcggggagccaggtgtactgggccaggcaagtggcagttgtacagtgctgatggcgcgagggaggc

SEQ ID NO: 1669 - DNA, 386 bp, Artificial Sequence
  Synthetic Template Oligonucleotide for IgH DJ Locus
gccttgccagcccgctcagcagtccaagtacagtgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaagtacagtggtcgacatacttccagcactggggccagggcaccctggtcaccgtctcctcaggtgagtctgctgtctggggatagcggggagccaggtgtactgggccaggcaagcagtccaagtacagtgctgatggcgcgagggaggc

SEQ ID NO: 1670 - DNA, 383 bp, Artificial Sequence
  Synthetic Template Oligonucleotide for IgH DJ Locus
gccttgccagcccgctcagtacgtacggtacagtgcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacggtacagtggtcgacatacttccagcactggggccagggcaccctggtcaccgtctcctcaggtgagtctgctgtctggggatagcggggagccaggtgtactgggccaggcaagtacgtacggtacagtgctgatggcgcgagggaggc

SEQ ID NO: 1671 - DNA, 377 bp, Artificial Sequence
  Synthetic Template Oligonucleotide for IgH DJ Locus
gccttgccagcccgctcagagtaccgagtacagtgagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgagtacagtggtcgacatacttccagcactggggccagggcaccctggtcaccgtctcctcaggtgagtctgctgtctggggatagcggggagccaggtgtactgggccaggcaagagtaccgagtacagtgctgatggcgcgagggaggc

SEQ ID NO: 1672 - DNA, 382 bp, Artificial Sequence
  Synthetic Template Oligonucleotide for IgH DJ Locus
gccttgccagcccgctcaggacactctggatcatcgccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctggatcatcgtcgactgctgggggcccctggacccgacccgccctggagaccgcagccacatcagcccccagccccacaggccccctaccagccgcagggttttggctgagctgagacactctggatcatcctgatggcgcgagggaggc

SEQ ID NO: 1673 - DNA, 382 bp, Artificial Sequence
  Synthetic Template Oligonucleotide for IgH DJ Locus
gccttgccagcccgctcagttcggaacggatcatcggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacggatcatcgtcgactgctgggggcccctggacccgacccgccctggagaccgcagccacatcagcccccagccccacaggccccctaccagccgcagggttttggctgagctgattcggaacggatcatcctgatggcgcgagggaggc

SEQ ID NO: 1674 - DNA, 382 bp, Artificial Sequence
  Synthetic Template Oligonucleotide for IgH DJ Locus
gccttgccagcccgctcagaagtaacgggatcatcggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgggatcatcgtcgactgctgggggcccctggacccgacccgccctggagaccgcagccacatcagcccccagccccacaggccccctaccagccgcagggttttggctgagctgaaagtaacgggatcatcctgatggcgcgagggaggc

SEQ ID NO: 1675 - DNA, 382 bp, Artificial Sequence
  Synthetic Template Oligonucleotide for IgH DJ Locus
gccttgccagcccgctcaggtctcctaggatcatcgtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctaggatcatcgtcgactgctgggggcccctggacccgacccgccctggagaccgcagccacatcagcccccagccccacaggccccctaccagccgcagggttttggctgagctgagtctcctaggatcatcctgatggcgcgagggaggc

SEQ ID NO: 1676 - DNA, 385 bp, Artificial Sequence
  Synthetic Template Oligonucleotide for IgH DJ Locus
gccttgccagcccgctcagagagtgtcggatcatcaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcggatcatcgtcgactgctgggggcccctggacccgacccgccctggagaccgcagccacatcagcccccagccccacaggccccctaccagccgcagggttttggctgagctgaagagtgtcggatcatcctgatggcgcgagggaggc

SEQ ID NO: 1677 - DNA, 396 bp, Artificial Sequence
  Synthetic Template Oligonucleotide for IgH DJ Locus
gccttgccagcccgctcaggttccgaaggatcatcaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaaggatcatcgtcgactgctgggggcccctggacccgacccgccctggagaccgcagccacatcagcccccagccccacaggccccctaccagccgcagggttttggctgagctgagttccgaaggatcatcctgatggcgcgagggaggc

SEQ ID NO: 1678 - DNA, 396 bp, Artificial Sequence
  Synthetic Template Oligonucleotide for IgH DJ Locus
gccttgccagcccgctcagcgttacttggatcatcaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttggatcatcgtcgactgctgggggcccctggacccgacccgccctggagaccgcagccacatcagcccccagccccacaggccccctaccagccgcagggttttggctgagctgacgttacttggatcatcctgatggcgcgagggaggc

SEQ ID NO: 1679 - DNA, 396 bp, Artificial Sequence
  Synthetic Template Oligonucleotide for IgH DJ Locus
gccttgccagcccgctcagtaggagacggatcatcaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacggatcatcgtcgactgctgggggcccctggacccgacccgccctggagaccgcagccacatcagcccccagccccacaggccccctaccagccgcagggttttggctgagctgataggagacggatcatcctgatggcgcgagggaggc

SEQ ID NO: 1680 - DNA, 393 bp, Artificial Sequence
  Synthetic Template Oligonucleotide for IgH DJ Locus
gccttgccagcccgctcaggtgtctacggatcatcagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacggatcatcgtcgactgctgggggcccctggacccgacccgccctggagaccgcagccacatcagcccccagccccacaggccccctaccagccgcagggttttggctgagctgagtgtctacggatcatcctgatggcgcgagggaggc

SEQ ID NO: 1681 - DNA, 396 bp, Artificial Sequence
  Synthetic Template Oligonucleotide for IgH DJ Locus
gccttgccagcccgctcagtgctacacggatcatcgtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacggatcatcgtcgactgctgggggcccctggacccgacccgccctggagaccgcagccacatcagcccccagccccacaggccccctaccagccgcagggttttggctgagctgatgctacacggatcatcctgatggcgcgagggaggc

SEQ ID NO: 1682 - DNA, 396 bp, Artificial Sequence
  Synthetic Template Oligonucleotide for IgH DJ Locus
gccttgccagcccgctcagaactgccaggatcatctgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccaggatcatcgtcgactgctgggggcccctggacccgacccgccctggagaccgcagccacatcagcccccagccccacaggccccctaccagccgcagggttttggctgagctgaaactgccaggatcatcctgatggcgcgagggaggc

SEQ ID NO: 1683 - DNA, 396 bp, Artificial Sequence
  Synthetic Template Oligonucleotide for IgH DJ Locus
gccttgccagcccgctcagttggactgggatcatccgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgggatcatcgtcgactgctgggggcccctggacccgacccgccctggagaccgcagccacatcagcccccagccccacaggccccctaccagccgcagggttttggctgagctgattggactgggatcatcctgatggcgcgagggaggc

SEQ ID NO: 1684 - DNA, 402 bp, Artificial Sequence
  Synthetic Template Oligonucleotide for IgH DJ Locus
gccttgccagcccgctcaggtagacacggatcatctggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacggatcatcgtcgactgctgggggcccctggacccgacccgccctggagaccgcagccacatcagcccccagccccacaggccccctaccagccgcagggttttggctgagctgagtagacacggatcatcctgatggcgcgagggaggc

SEQ ID NO: 1685 - DNA, 396 bp, Artificial Sequence
  Synthetic Template Oligonucleotide for IgH DJ Locus
gccttgccagcccgctcagcactgtacggatcatctgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacggatcatcgtcgactgctgggggcccctggacccgacccgccctggagaccgcagccacatcagcccccagccccacaggccccctaccagccgcagggttttggctgagctgacactgtacggatcatcctgatggcgcgagggaggc

SEQ ID NO: 1686 - DNA, 381 bp, Artificial Sequence
  Synthetic Template Oligonucleotide for IgH DJ Locus
gccttgccagcccgctcaggatgatccggatcatccaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccggatcatcgtcgactgctgggggcccctggacccgacccgccctggagaccgcagccacatcagcccccagccccacaggccccctaccagccgcagggttttggctgagctgagatgatccggatcatcctgatggcgcgagggaggc

SEQ ID NO: 1687 - DNA, 381 bp, Artificial Sequence
  Synthetic Template Oligonucleotide for IgH DJ Locus
gccttgccagcccgctcagcgccaataggatcatctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaataggatcatcgtcgactgctgggggcccctggacccgacccgccctggagaccgcagccacatcagcccccagccccacaggccccctaccagccgcagggttttggctgagctgacgccaataggatcatcctgatggcgcgagggaggc

SEQ ID NO: 1688 - DNA, 381 bp, Artificial Sequence
  Synthetic Template Oligonucleotide for IgH DJ Locus
gccttgccagcccgctcagtcaagcctggatcatcggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctggatcatcgtcgactgctgggggcccctggacccgacccgccctggagaccgcagccacatcagcccccagccccacaggccccctaccagccgcagggttttggctgagctgatcaagcctggatcatcctgatggcgcgagggaggc

SEQ ID NO: 1689 - DNA, 384 bp, Artificial Sequence
  Synthetic Template Oligonucleotide for IgH DJ Locus
gccttgccagcccgctcagacgtgtgtggatcatcggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtggatcatcgtcgactgctgggggcccctggacccgacccgccctggagaccgcagccacatcagcccccagccccacaggccccctaccagccgcagggttttggctgagctgaacgtgtgtggatcatcctgatggcgcgagggaggc

SEQ ID NO: 1690 - DNA, 385 bp, Artificial Sequence
  Synthetic Template Oligonucleotide for IgH DJ Locus
gccttgccagcccgctcagtccgtctaggatcatcagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctaggatcatcgtcgactgctgggggcccctggacccgacccgccctggagaccgcagccacatcagcccccagccccacaggccccctaccagccgcagggttttggctgagctgatccgtctaggatcatcctgatggcgcgagggaggc

SEQ ID NO: 1691 - DNA, 388 bp, Artificial Sequence
  Synthetic Template Oligonucleotide for IgH DJ Locus
gccttgccagcccgctcagaagagctgggatcatcgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgggatcatcgtcgactgctgggggcccctggacccgacccgccctggagaccgcagccacatcagcccccagccccacaggccccctaccagccgcagggttttggctgagctgaaagagctgggatcatcctgatggcgcgagggaggc

SEQ ID NO: 1692 - DNA, 385 bp, Artificial Sequence
  Synthetic Template Oligonucleotide for IgH DJ Locus
gccttgccagcccgctcagtatcgctcggatcatcgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcggatcatcgtcgactgctgggggcccctggacccgacccgccctggagaccgcagccacatcagcccccagccccacaggccccctaccagccgcagggttttggctgagctgatatcgctcggatcatcctgatggcgcgagggaggc

SEQ ID NO: 1693 - DNA, 385 bp, Artificial Sequence
  Synthetic Template Oligonucleotide for IgH DJ Locus
gccttgccagcccgctcagtcagatgcggatcatcgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcggatcatcgtcgactgctgggggcccctggacccgacccgccctggagaccgcagccacatcagcccccagccccacaggccccctaccagccgcagggttttggctgagctgatcagatgcggatcatcctgatggcgcgagggaggc

SEQ ID NO: 1694 - DNA, 383 bp, Artificial Sequence
  Synthetic Template Oligonucleotide for IgH DJ Locus
gccttgccagcccgctcaggtgtagcaggatcatcaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcaggatcatcgtcgactgctgggggcccctggacccgacccgccctggagaccgcagccacatcagcccccagccccacaggccccctaccagccgcagggttttggctgagctgagtgtagcaggatcatcctgatggcgcgagggaggc

SEQ ID NO: 1695 - DNA, 386 bp, Artificial Sequence
  Synthetic Template Oligonucleotide for IgH DJ Locus
gccttgccagcccgctcagtggcagttggatcatcaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttggatcatcgtcgactgctgggggcccctggacccgacccgccctggagaccgcagccacatcagcccccagccccacaggccccctaccagccgcagggttttggctgagctgatggcagttggatcatcctgatggcgcgagggaggc

SEQ ID NO: 1696 - DNA, 386 bp, Artificial Sequence
  Synthetic Template Oligonucleotide for IgH DJ Locus
gccttgccagcccgctcagcagtccaaggatcatctgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaaggatcatcgtcgactgctgggggcccctggacccgacccgccctggagaccgcagccacatcagcccccagccccacaggccccctaccagccgcagggttttggctgagctgacagtccaaggatcatcctgatggcgcgagggaggc

SEQ ID NO: 1697 - DNA, 383 bp, Artificial Sequence
  Synthetic Template Oligonucleotide for IgH DJ Locus
gccttgccagcccgctcagtacgtacgggatcatccagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgggatcatcgtcgactgctgggggcccctggacccgacccgccctggagaccgcagccacatcagcccccagccccacaggccccctaccagccgcagggttttggctgagctgatacgtacgggatcatcctgatggcgcgagggaggc

SEQ ID NO: 1698 - DNA, 377 bp, Artificial Sequence
  Synthetic Template Oligonucleotide for IgH DJ Locus
gccttgccagcccgctcagagtaccgaggatcatcagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgaggatcatcgtcgactgctgggggcccctggacccgacccgccctggagaccgcagccacatcagcccccagccccacaggccccctaccagccgcagggttttggctgagctgaagtaccgaggatcatcctgatggcgcgagggaggc

SEQ ID NO: 1699 - DNA, 382 bp, Artificial Sequence
  Synthetic Template Oligonucleotide for IgH DJ Locus
gccttgccagcccgctcaggacactcttattggcggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactcttattggcggtcgacggtacttcgatctctggggccgtggcaccctggtcactgtctcctcaggtgagtcccactgcagccccctcccagtcttctctgtccaggcaccaggccagacactcttattggcgctgatggcgcgagggaggc

SEQ ID NO: 1700 - DNA, 382 bp, Artificial Sequence
  Synthetic Template Oligonucleotide for IgH DJ Locus
gccttgccagcccgctcagttcggaactattggcgggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaactattggcggtcgacggtacttcgatctctggggccgtggcaccctggtcactgtctcctcaggtgagtcccactgcagccccctcccagtcttctctgtccaggcaccaggccattcggaactattggcgctgatggcgcgagggaggc

SEQ ID NO: 1701 - DNA, 382 bp, Artificial Sequence
  Synthetic Template Oligonucleotide for IgH DJ Locus
gccttgccagcccgctcagaagtaacgtattggcgggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgtattggcggtcgacggtacttcgatctctggggccgtggcaccctggtcactgtctcctcaggtgagtcccactgcagccccctcccagtcttctctgtccaggcaccaggccaaagtaacgtattggcgctgatggcgcgagggaggc

SEQ ID NO: 1702 - DNA, 382 bp, Artificial Sequence
  Synthetic Template Oligonucleotide for IgH DJ Locus
gccttgccagcccgctcaggtctcctatattggcggtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctatattggcggtcgacggtacttcgatctctggggccgtggcaccctggtcactgtctcctcaggtgagtcccactgcagccccctcccagtcttctctgtccaggcaccaggccagtctcctatattggcgctgatggcgcgagggaggc

SEQ ID NO: 1703 - DNA, 385 bp, Artificial Sequence
  Synthetic Template Oligonucleotide for IgH DJ Locus
gccttgccagcccgctcagagagtgtctattggcgaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtctattggcggtcgacggtacttcgatctctggggccgtggcaccctggtcactgtctcctcaggtgagtcccactgcagccccctcccagtcttctctgtccaggcaccaggccaagagtgtctattggcgctgatggcgcgagggaggc

SEQ ID NO: 1704 - DNA, 396 bp, Artificial Sequence
  Synthetic Template Oligonucleotide for IgH DJ Locus
gccttgccagcccgctcaggttccgaatattggcgaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaatattggcggtcgacggtacttcgatctctggggccgtggcaccctggtcactgtctcctcaggtgagtcccactgcagccccctcccagtcttctctgtccaggcaccaggccagttccgaatattggcgctgatggcgcgagggaggc

SEQ ID NO: 1705 - DNA, 396 bp, Artificial Sequence
  Synthetic Template Oligonucleotide for IgH DJ Locus
gccttgccagcccgctcagcgttactttattggcgaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttactttattggcggtcgacggtacttcgatctctggggccgtggcaccctggtcactgtctcctcaggtgagtcccactgcagccccctcccagtcttctctgtccaggcaccaggccacgttactttattggcgctgatggcgcgagggaggc

SEQ ID NO: 1706 - DNA, 396 bp, Artificial Sequence
  Synthetic Template Oligonucleotide for IgH DJ Locus
gccttgccagcccgctcagtaggagactattggcgaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagactattggcggtcgacggtacttcgatctctggggccgtggcaccctggtcactgtctcctcaggtgagtcccactgcagccccctcccagtcttctctgtccaggcaccaggccataggagactattggcgctgatggcgcgagggaggc

SEQ ID NO: 1707 - DNA, 393 bp, Artificial Sequence
  Synthetic Template Oligonucleotide for IgH DJ Locus
gccttgccagcccgctcaggtgtctactattggcgagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctactattggcggtcgacggtacttcgatctctggggccgtggcaccctggtcactgtctcctcaggtgagtcccactgcagccccctcccagtcttctctgtccaggcaccaggccagtgtctactattggcgctgatggcgcgagggaggc

SEQ ID NO: 1708 - DNA, 396 bp, Artificial Sequence
  Synthetic Template Oligonucleotide for IgH DJ Locus
gccttgccagcccgctcagtgctacactattggcggtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacactattggcggtcgacggtacttcgatctctggggccgtggcaccctggtcactgtctcctcaggtgagtcccactgcagccccctcccagtcttctctgtccaggcaccaggccatgctacactattggcgctgatggcgcgagggaggc

SEQ ID NO: 1709 - DNA, 396 bp, Artificial Sequence
  Synthetic Template Oligonucleotide for IgH DJ Locus
gccttgccagcccgctcagaactgccatattggcgtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccatattggcggtcgacggtacttcgatctctggggccgtggcaccctggtcactgtctcctcaggtgagtcccactgcagccccctcccagtcttctctgtccaggcaccaggccaaactgccatattggcgctgatggcgcgagggaggc

SEQ ID NO: 1710 - DNA, 396 bp, Artificial Sequence
  Synthetic Template Oligonucleotide for IgH DJ Locus
gccttgccagcccgctcagttggactgtattggcgcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgtattggcggtcgacggtacttcgatctctggggccgtggcaccctggtcactgtctcctcaggtgagtcccactgcagccccctcccagtcttctctgtccaggcaccaggccattggactgtattggcgctgatggcgcgagggaggc

SEQ ID NO: 1711 - DNA, 402 bp, Artificial Sequence
  Synthetic Template Oligonucleotide for IgH DJ Locus
gccttgccagcccgctcaggtagacactattggcgtggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacactattggcggtcgacggtacttcgatctctggggccgtggcaccctggtcactgtctcctcaggtgagtcccactgcagccccctcccagtcttctctgtccaggcaccaggccagtagacactattggcgctgatggcgcgagggaggc

SEQ ID NO: 1712 - DNA, 396 bp, Artificial Sequence
  Synthetic Template Oligonucleotide for IgH DJ Locus
gccttgccagcccgctcagcactgtactattggcgtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtactattggcggtcgacggtacttcgatctctggggccgtggcaccctggtcactgtctcctcaggtgagtcccactgcagccccctcccagtcttctctgtccaggcaccaggccacactgtactattggcgctgatggcgcgagggaggc

SEQ ID NO: 1713 - DNA, 381 bp, Artificial Sequence
  Synthetic Template Oligonucleotide for IgH DJ Locus
gccttgccagcccgctcaggatgatcctattggcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatcctattggcggtcgacggtacttcgatctctggggccgtggcaccctggtcactgtctcctcaggtgagtcccactgcagccccctcccagtcttctctgtccaggcaccaggccagatgatcctattggcgctgatggcgcgagggaggc

SEQ ID NO: 1714 - DNA, 381 bp, Artificial Sequence
  Synthetic Template Oligonucleotide for IgH DJ Locus
gccttgccagcccgctcagcgccaatatattggcgtgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatatattggcggtcgacggtacttcgatctctggggccgtggcaccctggtcactgtctcctcaggtgagtcccactgcagccccctcccagtcttctctgtccaggcaccaggccacgccaatatattggcgctgatggcgcgagggaggc

SEQ ID NO: 1715 - DNA, 381 bp, Artificial Sequence
  Synthetic Template Oligonucleotide for IgH DJ Locus
gccttgccagcccgctcagtcaagccttattggcgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagccttattggcggtcgacggtacttcgatctctggggccgtggcaccctggtcactgtctcctcaggtgagtcccactgcagccccctcccagtcttctctgtccaggcaccaggccatcaagccttattggcgctgatggcgcgagggaggc

SEQ ID NO: 1716 - DNA, 384 bp, Artificial Sequence
  Synthetic Template Oligonucleotide for IgH DJ Locus
gccttgccagcccgctcagacgtgtgttattggcgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgttattggcggtcgacggtacttcgatctctggggccgtggcaccctggtcactgtctcctcaggtgagtcccactgcagccccctcccagtcttctctgtccaggcaccaggccaacgtgtgttattggcgctgatggcgcgagggaggc

SEQ ID NO: 1717 - DNA, 385 bp, Artificial Sequence
  Synthetic Template Oligonucleotide for IgH DJ Locus
gccttgccagcccgctcagtccgtctatattggcgagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctatattggcggtcgacggtacttcgatctctggggccgtggcaccctggtcactgtctcctcaggtgagtcccactgcagccccctcccagtcttctctgtccaggcaccaggccatccgtctatattggcgctgatggcgcgagggaggc

SEQ ID NO: 1718 - DNA, 388 bp, Artificial Sequence
  Synthetic Template Oligonucleotide for IgH DJ Locus
gccttgccagcccgctcagaagagctgtattggcggcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgtattggcggtcgacggtacttcgatctctggggccgtggcaccctggtcactgtctcctcaggtgagtcccactgcagccccctcccagtcttctctgtccaggcaccaggccaaagagctgtattggcgctgatggcgcgagggaggc

SEQ ID NO: 1719 - DNA, 385 bp, Artificial Sequence
  Synthetic Template Oligonucleotide for IgH DJ Locus
gccttgccagcccgctcagtatcgctctattggcggcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctctattggcggtcgacggtacttcgatctctggggccgtggcaccctggtcactgtctcctcaggtgagtcccactgcagccccctcccagtcttctctgtccaggcaccaggccatatcgctctattggcgctgatggcgcgagggaggc

SEQ ID NO: 1720 - DNA, 385 bp, Artificial Sequence
  Synthetic Template Oligonucleotide for IgH DJ Locus
gccttgccagcccgctcagtcagatgctattggcggcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgctattggcggtcgacggtacttcgatctctggggccgtggcaccctggtcactgtctcctcaggtgagtcccactgcagccccctcccagtcttctctgtccaggcaccaggccatcagatgctattggcgctgatggcgcgagggaggc

SEQ ID NO: 1721 - DNA, 383 bp, Artificial Sequence
  Synthetic Template Oligonucleotide for IgH DJ Locus
gccttgccagcccgctcaggtgtagcatattggcgaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcatattggcggtcgacggtacttcgatctctggggccgtggcaccctggtcactgtctcctcaggtgagtcccactgcagccccctcccagtcttctctgtccaggcaccaggccagtgtagcatattggcgctgatggcgcgagggaggc

SEQ ID NO: 1722 - DNA, 386 bp, Artificial Sequence
  Synthetic Template Oligonucleotide for IgH DJ Locus
gccttgccagcccgctcagtggcagtttattggcgaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagtttattggcggtcgacggtacttcgatctctggggccgtggcaccctggtcactgtctcctcaggtgagtcccactgcagccccctcccagtcttctctgtccaggcaccaggccatggcagtttattggcgctgatggcgcgagggaggc

SEQ ID NO: 1723 - DNA, 386 bp, Artificial Sequence
  Synthetic Template Oligonucleotide for IgH DJ Locus
gccttgccagcccgctcagcagtccaatattggcgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaatattggcggtcgacggtacttcgatctctggggccgtggcaccctggtcactgtctcctcaggtgagtcccactgcagccccctcccagtcttctctgtccaggcaccaggccacagtccaatattggcgctgatggcgcgagggaggc

SEQ ID NO: 1724 - DNA, 383 bp, Artificial Sequence
  Synthetic Template Oligonucleotide for IgH DJ Locus
gccttgccagcccgctcagtacgtacgtattggcgcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgtattggcggtcgacggtacttcgatctctggggccgtggcaccctggtcactgtctcctcaggtgagtcccactgcagccccctcccagtcttctctgtccaggcaccaggccatacgtacgtattggcgctgatggcgcgagggaggc

SEQ ID NO: 1725 - DNA, 377 bp, Artificial Sequence
  Synthetic Template Oligonucleotide for IgH DJ Locus
gccttgccagcccgctcagagtaccgatattggcgagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgatattggcggtcgacggtacttcgatctctggggccgtggcaccctggtcactgtctcctcaggtgagtcccactgcagccccctcccagtcttctctgtccaggcaccaggccaagtaccgatattggcgctgatggcgcgagggaggc

SEQ ID NO: 1726 - DNA, 382 bp, Artificial Sequence
  Synthetic Template Oligonucleotide for IgH DJ Locus
gccttgccagcccgctcaggacactctaggcttgagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctaggcttgagtcgacaagtgcttggagcactggggccagggcagcccggccaccgtctccctgggaacgtcacccctccctgcctgggtctcagcccgggggtctgtgtggctgggacactctaggcttgactgatggcgcgagggaggc

SEQ ID NO: 1727 - DNA, 382 bp, Artificial Sequence
  Synthetic Template Oligonucleotide for IgH DJ Locus
gccttgccagcccgctcagttcggaacaggcttgaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacaggcttgagtcgacaagtgcttggagcactggggccagggcagcccggccaccgtctccctgggaacgtcacccctccctgcctgggtctcagcccgggggtctgtgtggctggttcggaacaggcttgactgatggcgcgagggaggc

SEQ ID NO: 1728 - DNA, 382 bp, Artificial Sequence
  Synthetic Template Oligonucleotide for IgH DJ Locus
gccttgccagcccgctcagaagtaacgaggcttgaggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgaggcttgagtcgacaagtgcttggagcactggggccagggcagcccggccaccgtctccctgggaacgtcacccctccctgcctgggtctcagcccgggggtctgtgtggctggaagtaacgaggcttgactgatggcgcgagggaggc

SEQ ID NO: 1729 - DNA, 382 bp, Artificial Sequence
  Synthetic Template Oligonucleotide for IgH DJ Locus
gccttgccagcccgctcaggtctcctaaggcttgagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctaaggcttgagtcgacaagtgcttggagcactggggccagggcagcccggccaccgtctccctgggaacgtcacccctccctgcctgggtctcagcccgggggtctgtgtggctgggtctcctaaggcttgactgatggcgcgagggaggc

SEQ ID NO: 1730 - DNA, 385 bp, Artificial Sequence
  Synthetic Template Oligonucleotide for IgH DJ Locus
gccttgccagcccgctcagagagtgtcaggcttgaaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcaggcttgagtcgacaagtgcttggagcactggggccagggcagcccggccaccgtctccctgggaacgtcacccctccctgcctgggtctcagcccgggggtctgtgtggctggagagtgtcaggcttgactgatggcgcgagggaggc

SEQ ID NO: 1731 - DNA, 396 bp, Artificial Sequence
  Synthetic Template Oligonucleotide for IgH DJ Locus
gccttgccagcccgctcaggttccgaaaggcttgaaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaaaggcttgagtcgacaagtgcttggagcactggggccagggcagcccggccaccgtctccctgggaacgtcacccctccctgcctgggtctcagcccgggggtctgtgtggctgggttccgaaaggcttgactgatggcgcgagggaggc

SEQ ID NO: 1732 - DNA, 396 bp, Artificial Sequence
  Synthetic Template Oligonucleotide for IgH DJ Locus
gccttgccagcccgctcagcgttacttaggcttgaaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttaggcttgagtcgacaagtgcttggagcactggggccagggcagcccggccaccgtctccctgggaacgtcacccctccctgcctgggtctcagcccgggggtctgtgtggctggcgttacttaggcttgactgatggcgcgagggaggc

SEQ ID NO: 1733 - DNA, 396 bp, Artificial Sequence
  Synthetic Template Oligonucleotide for IgH DJ Locus
gccttgccagcccgctcagtaggagacaggcttgaaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacaggcttgagtcgacaagtgcttggagcactggggccagggcagcccggccaccgtctccctgggaacgtcacccctccctgcctgggtctcagcccgggggtctgtgtggctggtaggagacaggcttgactgatggcgcgagggaggc

SEQ ID NO: 1734 - DNA, 393 bp, Artificial Sequence
  Synthetic Template Oligonucleotide for IgH DJ Locus
gccttgccagcccgctcaggtgtctacaggcttgaagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacaggcttgagtcgacaagtgcttggagcactggggccagggcagcccggccaccgtctccctgggaacgtcacccctccctgcctgggtctcagcccgggggtctgtgtggctgggtgtctacaggcttgactgatggcgcgagggaggc

SEQ ID NO: 1735 - DNA, 396 bp, Artificial Sequence
  Synthetic Template Oligonucleotide for IgH DJ Locus
gccttgccagcccgctcagtgctacacaggcttgagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacaggcttgagtcgacaagtgcttggagcactggggccagggcagcccggccaccgtctccctgggaacgtcacccctccctgcctgggtctcagcccgggggtctgtgtggctggtgctacacaggcttgactgatggcgcgagggaggc

SEQ ID NO: 1736 - DNA, 396 bp, Artificial Sequence
  Synthetic Template Oligonucleotide for IgH DJ Locus
gccttgccagcccgctcagaactgccaaggcttgatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccaaggcttgagtcgacaagtgcttggagcactggggccagggcagcccggccaccgtctccctgggaacgtcacccctccctgcctgggtctcagcccgggggtctgtgtggctggaactgccaaggcttgactgatggcgcgagggaggc

SEQ ID NO: 1737 - DNA, 396 bp, Artificial Sequence
  Synthetic Template Oligonucleotide for IgH DJ Locus
gccttgccagcccgctcagttggactgaggcttgacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgaggcttgagtcgacaagtgcttggagcactggggccagggcagcccggccaccgtctccctgggaacgtcacccctccctgcctgggtctcagcccgggggtctgtgtggctggttggactgaggcttgactgatggcgcgagggaggc

SEQ ID NO: 1738 - DNA, 402 bp, Artificial Sequence
  Synthetic Template Oligonucleotide for IgH DJ Locus
gccttgccagcccgctcaggtagacacaggcttgatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacaggcttgagtcgacaagtgcttggagcactggggccagggcagcccggccaccgtctccctgggaacgtcacccctccctgcctgggtctcagcccgggggtctgtgtggctgggtagacacaggcttgactgatggcgcgagggaggc

SEQ ID NO: 1739 - DNA, 396 bp, Artificial Sequence
  Synthetic Template Oligonucleotide for IgH DJ Locus
gccttgccagcccgctcagcactgtacaggcttgatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacaggcttgagtcgacaagtgcttggagcactggggccagggcagcccggccaccgtctccctgggaacgtcacccctccctgcctgggtctcagcccgggggtctgtgtggctggcactgtacaggcttgactgatggcgcgagggaggc

SEQ ID NO: 1740 - DNA, 381 bp, Artificial Sequence
  Synthetic Template Oligonucleotide for IgH DJ Locus
gccttgccagcccgctcaggatgatccaggcttgacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccaggcttgagtcgacaagtgcttggagcactggggccagggcagcccggccaccgtctccctgggaacgtcacccctccctgcctgggtctcagcccgggggtctgtgtggctgggatgatccaggcttgactgatggcgcgagggaggc

SEQ ID NO: 1741 - DNA, 381 bp, Artificial Sequence
  Synthetic Template Oligonucleotide for IgH DJ Locus
gccttgccagcccgctcagcgccaataaggcttgatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaataaggcttgagtcgacaagtgcttggagcactggggccagggcagcccggccaccgtctccctgggaacgtcacccctccctgcctgggtctcagcccgggggtctgtgtggctggcgccaataaggcttgactgatggcgcgagggaggc

SEQ ID NO: 1742 - DNA, 381 bp, Artificial Sequence
  Synthetic Template Oligonucleotide for IgH DJ Locus
gccttgccagcccgctcagtcaagcctaggcttgaggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctaggcttgagtcgacaagtgcttggagcactggggccagggcagcccggccaccgtctccctgggaacgtcacccctccctgcctgggtctcagcccgggggtctgtgtggctggtcaagcctaggcttgactgatggcgcgagggaggc

SEQ ID NO: 1743 - DNA, 384 bp, Artificial Sequence
  Synthetic Template Oligonucleotide for IgH DJ Locus
gccttgccagcccgctcagacgtgtgtaggcttgaggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtaggcttgagtcgacaagtgcttggagcactggggccagggcagcccggccaccgtctccctgggaacgtcacccctccctgcctgggtctcagcccgggggtctgtgtggctggacgtgtgtaggcttgactgatggcgcgagggaggc

SEQ ID NO: 1744 - DNA, 385 bp, Artificial Sequence
  Synthetic Template Oligonucleotide for IgH DJ Locus
gccttgccagcccgctcagtccgtctaaggcttgaagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctaaggcttgagtcgacaagtgcttggagcactggggccagggcagcccggccaccgtctccctgggaacgtcacccctccctgcctgggtctcagcccgggggtctgtgtggctggtccgtctaaggcttgactgatggcgcgagggaggc

SEQ ID NO: 1745 - DNA, 388 bp, Artificial Sequence
  Synthetic Template Oligonucleotide for IgH DJ Locus
gccttgccagcccgctcagaagagctgaggcttgagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgaggcttgagtcgacaagtgcttggagcactggggccagggcagcccggccaccgtctccctgggaacgtcacccctccctgcctgggtctcagcccgggggtctgtgtggctggaagagctgaggcttgactgatggcgcgagggaggc

SEQ ID NO: 1746 - DNA, 385 bp, Artificial Sequence
  Synthetic Template Oligonucleotide for IgH DJ Locus
gccttgccagcccgctcagtatcgctcaggcttgagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcaggcttgagtcgacaagtgcttggagcactggggccagggcagcccggccaccgtctccctgggaacgtcacccctccctgcctgggtctcagcccgggggtctgtgtggctggtatcgctcaggcttgactgatggcgcgagggaggc

SEQ ID NO: 1747 - DNA, 385 bp, Artificial Sequence
  Synthetic Template Oligonucleotide for IgH DJ Locus
gccttgccagcccgctcagtcagatgcaggcttgagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcaggcttgagtcgacaagtgcttggagcactggggccagggcagcccggccaccgtctccctgggaacgtcacccctccctgcctgggtctcagcccgggggtctgtgtggctggtcagatgcaggcttgactgatggcgcgagggaggc

SEQ ID NO: 1748 - DNA, 383 bp, Artificial Sequence
  Synthetic Template Oligonucleotide for IgH DJ Locus
gccttgccagcccgctcaggtgtagcaaggcttgaaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcaaggcttgagtcgacaagtgcttggagcactggggccagggcagcccggccaccgtctccctgggaacgtcacccctccctgcctgggtctcagcccgggggtctgtgtggctgggtgtagcaaggcttgactgatggcgcgagggaggc

SEQ ID NO: 1749 - DNA, 386 bp, Artificial Sequence
  Synthetic Template Oligonucleotide for IgH DJ Locus
gccttgccagcccgctcagtggcagttaggcttgaaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttaggcttgagtcgacaagtgcttggagcactggggccagggcagcccggccaccgtctccctgggaacgtcacccctccctgcctgggtctcagcccgggggtctgtgtggctggtggcagttaggcttgactgatggcgcgagggaggc

SEQ ID NO: 1750 - DNA, 386 bp, Artificial Sequence
  Synthetic Template Oligonucleotide for IgH DJ Locus
gccttgccagcccgctcagcagtccaaaggcttgatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaaaggcttgagtcgacaagtgcttggagcactggggccagggcagcccggccaccgtctccctgggaacgtcacccctccctgcctgggtctcagcccgggggtctgtgtggctggcagtccaaaggcttgactgatggcgcgagggaggc

SEQ ID NO: 1751 - DNA, 383 bp, Artificial Sequence
  Synthetic Template Oligonucleotide for IgH DJ Locus
gccttgccagcccgctcagtacgtacgaggcttgacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgaggcttgagtcgacaagtgcttggagcactggggccagggcagcccggccaccgtctccctgggaacgtcacccctccctgcctgggtctcagcccgggggtctgtgtggctggtacgtacgaggcttgactgatggcgcgagggaggc

SEQ ID NO: 1752 - DNA, 377 bp, Artificial Sequence
  Synthetic Template Oligonucleotide for IgH DJ Locus
gccttgccagcccgctcagagtaccgaaggcttgaagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgaaggcttgagtcgacaagtgcttggagcactggggccagggcagcccggccaccgtctccctgggaacgtcacccctccctgcctgggtctcagcccgggggtctgtgtggctggagtaccgaaggcttgactgatggcgcgagggaggc

SEQ ID NO: 1753 - DNA, 382 bp, Artificial Sequence
  Synthetic Template Oligonucleotide for IgH DJ Locus
gccttgccagcccgctcaggacactctacacacgtgccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctacacacgtgtcgaccttttgatatctggggccaagggacaatggtcaccgtctcttcaggtaagatggctttccttctgcctcctttctctgggcccagcgtcctctgtcctgggacactctacacacgtctgatggcgcgagggaggc

SEQ ID NO: 1754 - DNA, 382 bp, Artificial Sequence
  Synthetic Template Oligonucleotide for IgH DJ Locus
gccttgccagcccgctcagttcggaacacacacgtggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacacacacgtgtcgaccttttgatatctggggccaagggacaatggtcaccgtctcttcaggtaagatggctttccttctgcctcctttctctgggcccagcgtcctctgtcctggttcggaacacacacgtctgatggcgcgagggaggc

SEQ ID NO: 1755 - DNA, 382 bp, Artificial Sequence
  Synthetic Template Oligonucleotide for IgH DJ Locus
gccttgccagcccgctcagaagtaacgacacacgtggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgacacacgtgtcgaccttttgatatctggggccaagggacaatggtcaccgtctcttcaggtaagatggctttccttctgcctcctttctctgggcccagcgtcctctgtcctggaagtaacgacacacgtctgatggcgcgagggaggc

SEQ ID NO: 1756 - DNA, 382 bp, Artificial Sequence
  Synthetic Template Oligonucleotide for IgH DJ Locus
gccttgccagcccgctcaggtctcctaacacacgtgtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctaacacacgtgtcgaccttttgatatctggggccaagggacaatggtcaccgtctcttcaggtaagatggctttccttctgcctcctttctctgggcccagcgtcctctgtcctgggtctcctaacacacgtctgatggcgcgagggaggc

SEQ ID NO: 1757 - DNA, 385 bp, Artificial Sequence
  Synthetic Template Oligonucleotide for IgH DJ Locus
gccttgccagcccgctcagagagtgtcacacacgtaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcacacacgtgtcgaccttttgatatctggggccaagggacaatggtcaccgtctcttcaggtaagatggctttccttctgcctcctttctctgggcccagcgtcctctgtcctggagagtgtcacacacgtctgatggcgcgagggaggc

SEQ ID NO: 1758 - DNA, 396 bp, Artificial Sequence
  Synthetic Template Oligonucleotide for IgH DJ Locus
gccttgccagcccgctcaggttccgaaacacacgtaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaaacacacgtgtcgaccttttgatatctggggccaagggacaatggtcaccgtctcttcaggtaagatggctttccttctgcctcctttctctgggcccagcgtcctctgtcctgggttccgaaacacacgtctgatggcgcgagggaggc

SEQ ID NO: 1759 - DNA, 396 bp, Artificial Sequence
  Synthetic Template Oligonucleotide for IgH DJ Locus
gccttgccagcccgctcagcgttacttacacacgtaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttacacacgtgtcgaccttttgatatctggggccaagggacaatggtcaccgtctcttcaggtaagatggctttccttctgcctcctttctctgggcccagcgtcctctgtcctggcgttacttacacacgtctgatggcgcgagggaggc

SEQ ID NO: 1760 - DNA, 396 bp, Artificial Sequence
  Synthetic Template Oligonucleotide for IgH DJ Locus
gccttgccagcccgctcagtaggagacacacacgtaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacacacacgtgtcgaccttttgatatctggggccaagggacaatggtcaccgtctcttcaggtaagatggctttccttctgcctcctttctctgggcccagcgtcctctgtcctggtaggagacacacacgtctgatggcgcgagggaggc

SEQ ID NO: 1761 - DNA, 393 bp, Artificial Sequence
  Synthetic Template Oligonucleotide for IgH DJ Locus
gccttgccagcccgctcaggtgtctacacacacgtagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacacacacgtgtcgaccttttgatatctggggccaagggacaatggtcaccgtctcttcaggtaagatggctttccttctgcctcctttctctgggcccagcgtcctctgtcctgggtgtctacacacacgtctgatggcgcgagggaggc

SEQ ID NO: 1762 - DNA, 396 bp, Artificial Sequence
  Synthetic Template Oligonucleotide for IgH DJ Locus
gccttgccagcccgctcagtgctacacacacacgtgtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacacacacgtgtcgaccttttgatatctggggccaagggacaatggtcaccgtctcttcaggtaagatggctttccttctgcctcctttctctgggcccagcgtcctctgtcctggtgctacacacacacgtctgatggcgcgagggaggc

SEQ ID NO: 1763 - DNA, 396 bp, Artificial Sequence
  Synthetic Template Oligonucleotide for IgH DJ Locus
gccttgccagcccgctcagaactgccaacacacgttgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccaacacacgtgtcgaccttttgatatctggggccaagggacaatggtcaccgtctcttcaggtaagatggctttccttctgcctcctttctctgggcccagcgtcctctgtcctggaactgccaacacacgtctgatggcgcgagggaggc

SEQ ID NO: 1764 - DNA, 396 bp, Artificial Sequence
  Synthetic Template Oligonucleotide for IgH DJ Locus
gccttgccagcccgctcagttggactgacacacgtcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgacacacgtgtcgaccttttgatatctggggccaagggacaatggtcaccgtctcttcaggtaagatggctttccttctgcctcctttctctgggcccagcgtcctctgtcctggttggactgacacacgtctgatggcgcgagggaggc

SEQ ID NO: 1765 - DNA, 402 bp, Artificial Sequence
  Synthetic Template Oligonucleotide for IgH DJ Locus
gccttgccagcccgctcaggtagacacacacacgttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacacacacgtgtcgaccttttgatatctggggccaagggacaatggtcaccgtctcttcaggtaagatggctttccttctgcctcctttctctgggcccagcgtcctctgtcctgggtagacacacacacgtctgatggcgcgagggaggc

SEQ ID NO: 1766 - DNA, 396 bp, Artificial Sequence
  Synthetic Template Oligonucleotide for IgH DJ Locus
gccttgccagcccgctcagcactgtacacacacgttgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacacacacgtgtcgaccttttgatatctggggccaagggacaatggtcaccgtctcttcaggtaagatggctttccttctgcctcctttctctgggcccagcgtcctctgtcctggcactgtacacacacgtctgatggcgcgagggaggc

SEQ ID NO: 1767 - DNA, 381 bp, Artificial Sequence
  Synthetic Template Oligonucleotide for IgH DJ Locus
gccttgccagcccgctcaggatgatccacacacgtcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccacacacgtgtcgaccttttgatatctggggccaagggacaatggtcaccgtctcttcaggtaagatggctttccttctgcctcctttctctgggcccagcgtcctctgtcctgggatgatccacacacgtctgatggcgcgagggaggc

SEQ ID NO: 1768 - DNA, 381 bp, Artificial Sequence
  Synthetic Template Oligonucleotide for IgH DJ Locus
gccttgccagcccgctcagcgccaataacacacgttgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaataacacacgtgtcgaccttttgatatctggggccaagggacaatggtcaccgtctcttcaggtaagatggctttccttctgcctcctttctctgggcccagcgtcctctgtcctggcgccaataacacacgtctgatggcgcgagggaggc

SEQ ID NO: 1769 - DNA, 381 bp, Artificial Sequence
  Synthetic Template Oligonucleotide for IgH DJ Locus
gccttgccagcccgctcagtcaagcctacacacgtggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctacacacgtgtcgaccttttgatatctggggccaagggacaatggtcaccgtctcttcaggtaagatggctttccttctgcctcctttctctgggcccagcgtcctctgtcctggtcaagcctacacacgtctgatggcgcgagggaggc

SEQ ID NO: 1770 - DNA, 384 bp, Artificial Sequence
  Synthetic Template Oligonucleotide for IgH DJ Locus
gccttgccagcccgctcagacgtgtgtacacacgtggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtacacacgtgtcgaccttttgatatctggggccaagggacaatggtcaccgtctcttcaggtaagatggctttccttctgcctcctttctctgggcccagcgtcctctgtcctggacgtgtgtacacacgtctgatggcgcgagggaggc

SEQ ID NO: 1771 - DNA, 385 bp, Artificial Sequence
  Synthetic Template Oligonucleotide for IgH DJ Locus
gccttgccagcccgctcagtccgtctaacacacgtagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctaacacacgtgtcgaccttttgatatctggggccaagggacaatggtcaccgtctcttcaggtaagatggctttccttctgcctcctttctctgggcccagcgtcctctgtcctggtccgtctaacacacgtctgatggcgcgagggaggc

SEQ ID NO: 1772 - DNA, 388 bp, Artificial Sequence
  Synthetic Template Oligonucleotide for IgH DJ Locus
gccttgccagcccgctcagaagagctgacacacgtgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgacacacgtgtcgaccttttgatatctggggccaagggacaatggtcaccgtctcttcaggtaagatggctttccttctgcctcctttctctgggcccagcgtcctctgtcctggaagagctgacacacgtctgatggcgcgagggaggc

SEQ ID NO: 1773 - DNA, 385 bp, Artificial Sequence
  Synthetic Template Oligonucleotide for IgH DJ Locus
gccttgccagcccgctcagtatcgctcacacacgtgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcacacacgtgtcgaccttttgatatctggggccaagggacaatggtcaccgtctcttcaggtaagatggctttccttctgcctcctttctctgggcccagcgtcctctgtcctggtatcgctcacacacgtctgatggcgcgagggaggc

SEQ ID NO: 1774 - DNA, 385 bp, Artificial Sequence
  Synthetic Template Oligonucleotide for IgH DJ Locus
gccttgccagcccgctcagtcagatgcacacacgtgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcacacacgtgtcgaccttttgatatctggggccaagggacaatggtcaccgtctcttcaggtaagatggctttccttctgcctcctttctctgggcccagcgtcctctgtcctggtcagatgcacacacgtctgatggcgcgagggaggc

SEQ ID NO: 1775 - DNA, 383 bp, Artificial Sequence
  Synthetic Template Oligonucleotide for IgH DJ Locus
gccttgccagcccgctcaggtgtagcaacacacgtaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcaacacacgtgtcgaccttttgatatctggggccaagggacaatggtcaccgtctcttcaggtaagatggctttccttctgcctcctttctctgggcccagcgtcctctgtcctgggtgtagcaacacacgtctgatggcgcgagggaggc

SEQ ID NO: 1776 - DNA, 386 bp, Artificial Sequence
  Synthetic Template Oligonucleotide for IgH DJ Locus
gccttgccagcccgctcagtggcagttacacacgtaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttacacacgtgtcgaccttttgatatctggggccaagggacaatggtcaccgtctcttcaggtaagatggctttccttctgcctcctttctctgggcccagcgtcctctgtcctggtggcagttacacacgtctgatggcgcgagggaggc

SEQ ID NO: 1777 - DNA, 386 bp, Artificial Sequence
  Synthetic Template Oligonucleotide for IgH DJ Locus
gccttgccagcccgctcagcagtccaaacacacgttgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaaacacacgtgtcgaccttttgatatctggggccaagggacaatggtcaccgtctcttcaggtaagatggctttccttctgcctcctttctctgggcccagcgtcctctgtcctggcagtccaaacacacgtctgatggcgcgagggaggc

SEQ ID NO: 1778 - DNA, 383 bp, Artificial Sequence
  Synthetic Template Oligonucleotide for IgH DJ Locus
gccttgccagcccgctcagtacgtacgacacacgtcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgacacacgtgtcgaccttttgatatctggggccaagggacaatggtcaccgtctcttcaggtaagatggctttccttctgcctcctttctctgggcccagcgtcctctgtcctggtacgtacgacacacgtctgatggcgcgagggaggc

SEQ ID NO: 1779 - DNA, 377 bp, Artificial Sequence
  Synthetic Template Oligonucleotide for IgH DJ Locus
gccttgccagcccgctcagagtaccgaacacacgtagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgaacacacgtgtcgaccttttgatatctggggccaagggacaatggtcaccgtctcttcaggtaagatggctttccttctgcctcctttctctgggcccagcgtcctctgtcctggagtaccgaacacacgtctgatggcgcgagggaggc

SEQ ID NO: 1780 - DNA, 382 bp, Artificial Sequence
  Synthetic Template Oligonucleotide for IgH DJ Locus
gccttgccagcccgctcaggacactcttagacggagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactcttagacggagtcgacagttggacttcccaggccgacagtggtctggcttctgaggggtcaggccagaatgtggggtacgtgggaggccagcagagggttccatgagaagggcagggacactcttagacggactgatggcgcgagggaggc

SEQ ID NO: 1781 - DNA, 382 bp, Artificial Sequence
  Synthetic Template Oligonucleotide for IgH DJ Locus
gccttgccagcccgctcagttcggaactagacggaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaactagacggagtcgacagttggacttcccaggccgacagtggtctggcttctgaggggtcaggccagaatgtggggtacgtgggaggccagcagagggttccatgagaagggcaggttcggaactagacggactgatggcgcgagggaggc

SEQ ID NO: 1782 - DNA, 382 bp, Artificial Sequence
  Synthetic Template Oligonucleotide for IgH DJ Locus
gccttgccagcccgctcagaagtaacgtagacggaggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgtagacggagtcgacagttggacttcccaggccgacagtggtctggcttctgaggggtcaggccagaatgtggggtacgtgggaggccagcagagggttccatgagaagggcaggaagtaacgtagacggactgatggcgcgagggaggc

SEQ ID NO: 1783 - DNA, 382 bp, Artificial Sequence
  Synthetic Template Oligonucleotide for IgH DJ Locus
gccttgccagcccgctcaggtctcctatagacggagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctatagacggagtcgacagttggacttcccaggccgacagtggtctggcttctgaggggtcaggccagaatgtggggtacgtgggaggccagcagagggttccatgagaagggcagggtctcctatagacggactgatggcgcgagggaggc

SEQ ID NO: 1784 - DNA, 385 bp, Artificial Sequence
  Synthetic Template Oligonucleotide for IgH DJ Locus
gccttgccagcccgctcagagagtgtctagacggaaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtctagacggagtcgacagttggacttcccaggccgacagtggtctggcttctgaggggtcaggccagaatgtggggtacgtgggaggccagcagagggttccatgagaagggcaggagagtgtctagacggactgatggcgcgagggaggc

SEQ ID NO: 1785 - DNA, 396 bp, Artificial Sequence
  Synthetic Template Oligonucleotide for IgH DJ Locus
gccttgccagcccgctcaggttccgaatagacggaaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaatagacggagtcgacagttggacttcccaggccgacagtggtctggcttctgaggggtcaggccagaatgtggggtacgtgggaggccagcagagggttccatgagaagggcagggttccgaatagacggactgatggcgcgagggaggc

SEQ ID NO: 1786 - DNA, 396 bp, Artificial Sequence
  Synthetic Template Oligonucleotide for IgH DJ Locus
gccttgccagcccgctcagcgttactttagacggaaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttactttagacggagtcgacagttggacttcccaggccgacagtggtctggcttctgaggggtcaggccagaatgtggggtacgtgggaggccagcagagggttccatgagaagggcaggcgttactttagacggactgatggcgcgagggaggc

SEQ ID NO: 1787 - DNA, 396 bp, Artificial Sequence
  Synthetic Template Oligonucleotide for IgH DJ Locus
gccttgccagcccgctcagtaggagactagacggaaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagactagacggagtcgacagttggacttcccaggccgacagtggtctggcttctgaggggtcaggccagaatgtggggtacgtgggaggccagcagagggttccatgagaagggcaggtaggagactagacggactgatggcgcgagggaggc

SEQ ID NO: 1788 - DNA, 393 bp, Artificial Sequence
  Synthetic Template Oligonucleotide for IgH DJ Locus
gccttgccagcccgctcaggtgtctactagacggaagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctactagacggagtcgacagttggacttcccaggccgacagtggtctggcttctgaggggtcaggccagaatgtggggtacgtgggaggccagcagagggttccatgagaagggcagggtgtctactagacggactgatggcgcgagggaggc

SEQ ID NO: 1789 - DNA, 396 bp, Artificial Sequence
  Synthetic Template Oligonucleotide for IgH DJ Locus
gccttgccagcccgctcagtgctacactagacggagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacactagacggagtcgacagttggacttcccaggccgacagtggtctggcttctgaggggtcaggccagaatgtggggtacgtgggaggccagcagagggttccatgagaagggcaggtgctacactagacggactgatggcgcgagggaggc

SEQ ID NO: 1790 - DNA, 396 bp, Artificial Sequence
  Synthetic Template Oligonucleotide for IgH DJ Locus
gccttgccagcccgctcagaactgccatagacggatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccatagacggagtcgacagttggacttcccaggccgacagtggtctggcttctgaggggtcaggccagaatgtggggtacgtgggaggccagcagagggttccatgagaagggcaggaactgccatagacggactgatggcgcgagggaggc

SEQ ID NO: 1791 - DNA, 396 bp, Artificial Sequence
  Synthetic Template Oligonucleotide for IgH DJ Locus
gccttgccagcccgctcagttggactgtagacggacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgtagacggagtcgacagttggacttcccaggccgacagtggtctggcttctgaggggtcaggccagaatgtggggtacgtgggaggccagcagagggttccatgagaagggcaggttggactgtagacggactgatggcgcgagggaggc

SEQ ID NO: 1792 - DNA, 402 bp, Artificial Sequence
  Synthetic Template Oligonucleotide for IgH DJ Locus
gccttgccagcccgctcaggtagacactagacggatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacactagacggagtcgacagttggacttcccaggccgacagtggtctggcttctgaggggtcaggccagaatgtggggtacgtgggaggccagcagagggttccatgagaagggcagggtagacactagacggactgatggcgcgagggaggc

SEQ ID NO: 1793 - DNA, 396 bp, Artificial Sequence
  Synthetic Template Oligonucleotide for IgH DJ Locus
gccttgccagcccgctcagcactgtactagacggatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtactagacggagtcgacagttggacttcccaggccgacagtggtctggcttctgaggggtcaggccagaatgtggggtacgtgggaggccagcagagggttccatgagaagggcaggcactgtactagacggactgatggcgcgagggaggc

SEQ ID NO: 1794 - DNA, 381 bp, Artificial Sequence
  Synthetic Template Oligonucleotide for IgH DJ Locus
gccttgccagcccgctcaggatgatcctagacggacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatcctagacggagtcgacagttggacttcccaggccgacagtggtctggcttctgaggggtcaggccagaatgtggggtacgtgggaggccagcagagggttccatgagaagggcagggatgatcctagacggactgatggcgcgagggaggc

SEQ ID NO: 1795 - DNA, 381 bp, Artificial Sequence
  Synthetic Template Oligonucleotide for IgH DJ Locus
gccttgccagcccgctcagcgccaatatagacggatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatatagacggagtcgacagttggacttcccaggccgacagtggtctggcttctgaggggtcaggccagaatgtggggtacgtgggaggccagcagagggttccatgagaagggcaggcgccaatatagacggactgatggcgcgagggaggc

SEQ ID NO: 1796 - DNA, 381 bp, Artificial Sequence
  Synthetic Template Oligonucleotide for IgH DJ Locus
gccttgccagcccgctcagtcaagccttagacggaggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagccttagacggagtcgacagttggacttcccaggccgacagtggtctggcttctgaggggtcaggccagaatgtggggtacgtgggaggccagcagagggttccatgagaagggcaggtcaagccttagacggactgatggcgcgagggaggc

SEQ ID NO: 1797 - DNA, 384 bp, Artificial Sequence
  Synthetic Template Oligonucleotide for IgH DJ Locus
gccttgccagcccgctcagacgtgtgttagacggaggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgttagacggagtcgacagttggacttcccaggccgacagtggtctggcttctgaggggtcaggccagaatgtggggtacgtgggaggccagcagagggttccatgagaagggcaggacgtgtgttagacggactgatggcgcgagggaggc

SEQ ID NO: 1798 - DNA, 385 bp, Artificial Sequence
  Synthetic Template Oligonucleotide for IgH DJ Locus
gccttgccagcccgctcagtccgtctatagacggaagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctatagacggagtcgacagttggacttcccaggccgacagtggtctggcttctgaggggtcaggccagaatgtggggtacgtgggaggccagcagagggttccatgagaagggcaggtccgtctatagacggactgatggcgcgagggaggc

SEQ ID NO: 1799 - DNA, 388 bp, Artificial Sequence
  Synthetic Template Oligonucleotide for IgH DJ Locus
gccttgccagcccgctcagaagagctgtagacggagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgtagacggagtcgacagttggacttcccaggccgacagtggtctggcttctgaggggtcaggccagaatgtggggtacgtgggaggccagcagagggttccatgagaagggcaggaagagctgtagacggactgatggcgcgagggaggc

SEQ ID NO: 1800 - DNA, 385 bp, Artificial Sequence
  Synthetic Template Oligonucleotide for IgH DJ Locus
gccttgccagcccgctcagtatcgctctagacggagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctctagacggagtcgacagttggacttcccaggccgacagtggtctggcttctgaggggtcaggccagaatgtggggtacgtgggaggccagcagagggttccatgagaagggcaggtatcgctctagacggactgatggcgcgagggaggc

SEQ ID NO: 1801 - DNA, 385 bp, Artificial Sequence
  Synthetic Template Oligonucleotide for IgH DJ Locus
gccttgccagcccgctcagtcagatgctagacggagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgctagacggagtcgacagttggacttcccaggccgacagtggtctggcttctgaggggtcaggccagaatgtggggtacgtgggaggccagcagagggttccatgagaagggcaggtcagatgctagacggactgatggcgcgagggaggc

SEQ ID NO: 1802 - DNA, 383 bp, Artificial Sequence
  Synthetic Template Oligonucleotide for IgH DJ Locus
gccttgccagcccgctcaggtgtagcatagacggaaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcatagacggagtcgacagttggacttcccaggccgacagtggtctggcttctgaggggtcaggccagaatgtggggtacgtgggaggccagcagagggttccatgagaagggcagggtgtagcatagacggactgatggcgcgagggaggc

SEQ ID NO: 1803 - DNA, 386 bp, Artificial Sequence
  Synthetic Template Oligonucleotide for IgH DJ Locus
gccttgccagcccgctcagtggcagtttagacggaaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagtttagacggagtcgacagttggacttcccaggccgacagtggtctggcttctgaggggtcaggccagaatgtggggtacgtgggaggccagcagagggttccatgagaagggcaggtggcagtttagacggactgatggcgcgagggaggc

SEQ ID NO: 1804 - DNA, 386 bp, Artificial Sequence
  Synthetic Template Oligonucleotide for IgH DJ Locus
gccttgccagcccgctcagcagtccaatagacggatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaatagacggagtcgacagttggacttcccaggccgacagtggtctggcttctgaggggtcaggccagaatgtggggtacgtgggaggccagcagagggttccatgagaagggcaggcagtccaatagacggactgatggcgcgagggaggc

SEQ ID NO: 1805 - DNA, 383 bp, Artificial Sequence
  Synthetic Template Oligonucleotide for IgH DJ Locus
gccttgccagcccgctcagtacgtacgtagacggacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgtagacggagtcgacagttggacttcccaggccgacagtggtctggcttctgaggggtcaggccagaatgtggggtacgtgggaggccagcagagggttccatgagaagggcaggtacgtacgtagacggactgatggcgcgagggaggc

SEQ ID NO: 1806 - DNA, 377 bp, Artificial Sequence
  Synthetic Template Oligonucleotide for IgH DJ Locus
gccttgccagcccgctcagagtaccgatagacggaagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgatagacggagtcgacagttggacttcccaggccgacagtggtctggcttctgaggggtcaggccagaatgtggggtacgtgggaggccagcagagggttccatgagaagggcaggagtaccgatagacggactgatggcgcgagggaggc

SEQ ID NO: 1807 - DNA, 382 bp, Artificial Sequence
  Synthetic Template Oligonucleotide for IgH DJ Locus
gccttgccagcccgctcaggacactctcagctcttgccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctcagctcttgtcgactttgactactggggccagggaaccctggtcaccgtctcctcaggtgagtcctcacaacctctctcctgctttaactctgaagggttttgctgcatttctggacactctcagctcttctgatggcgcgagggaggc

SEQ ID NO: 1808 - DNA, 382 bp, Artificial Sequence
  Synthetic Template Oligonucleotide for IgH DJ Locus
gccttgccagcccgctcagttcggaaccagctcttggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaaccagctcttgtcgactttgactactggggccagggaaccctggtcaccgtctcctcaggtgagtcctcacaacctctctcctgctttaactctgaagggttttgctgcatttctgttcggaaccagctcttctgatggcgcgagggaggc

SEQ ID NO: 1809 - DNA, 382 bp, Artificial Sequence
  Synthetic Template Oligonucleotide for IgH DJ Locus
gccttgccagcccgctcagaagtaacgcagctcttggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgcagctcttgtcgactttgactactggggccagggaaccctggtcaccgtctcctcaggtgagtcctcacaacctctctcctgctttaactctgaagggttttgctgcatttctgaagtaacgcagctcttctgatggcgcgagggaggc

SEQ ID NO: 1810 - DNA, 382 bp, Artificial Sequence
  Synthetic Template Oligonucleotide for IgH DJ Locus
gccttgccagcccgctcaggtctcctacagctcttgtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctacagctcttgtcgactttgactactggggccagggaaccctggtcaccgtctcctcaggtgagtcctcacaacctctctcctgctttaactctgaagggttttgctgcatttctggtctcctacagctcttctgatggcgcgagggaggc

SEQ ID NO: 1811 - DNA, 385 bp, Artificial Sequence
  Synthetic Template Oligonucleotide for IgH DJ Locus
gccttgccagcccgctcagagagtgtccagctcttaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtccagctcttgtcgactttgactactggggccagggaaccctggtcaccgtctcctcaggtgagtcctcacaacctctctcctgctttaactctgaagggttttgctgcatttctgagagtgtccagctcttctgatggcgcgagggaggc

SEQ ID NO: 1812 - DNA, 396 bp, Artificial Sequence
  Synthetic Template Oligonucleotide for IgH DJ Locus
gccttgccagcccgctcaggttccgaacagctcttaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaacagctcttgtcgactttgactactggggccagggaaccctggtcaccgtctcctcaggtgagtcctcacaacctctctcctgctttaactctgaagggttttgctgcatttctggttccgaacagctcttctgatggcgcgagggaggc

SEQ ID NO: 1813 - DNA, 396 bp, Artificial Sequence
  Synthetic Template Oligonucleotide for IgH DJ Locus
gccttgccagcccgctcagcgttacttcagctcttaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttcagctcttgtcgactttgactactggggccagggaaccctggtcaccgtctcctcaggtgagtcctcacaacctctctcctgctttaactctgaagggttttgctgcatttctgcgttacttcagctcttctgatggcgcgagggaggc

SEQ ID NO: 1814 - DNA, 396 bp, Artificial Sequence
  Synthetic Template Oligonucleotide for IgH DJ Locus
gccttgccagcccgctcagtaggagaccagctcttaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagaccagctcttgtcgactttgactactggggccagggaaccctggtcaccgtctcctcaggtgagtcctcacaacctctctcctgctttaactctgaagggttttgctgcatttctgtaggagaccagctcttctgatggcgcgagggaggc

SEQ ID NO: 1815 - DNA, 393 bp, Artificial Sequence
  Synthetic Template Oligonucleotide for IgH DJ Locus
gccttgccagcccgctcaggtgtctaccagctcttagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctaccagctcttgtcgactttgactactggggccagggaaccctggtcaccgtctcctcaggtgagtcctcacaacctctctcctgctttaactctgaagggttttgctgcatttctggtgtctaccagctcttctgatggcgcgagggaggc

SEQ ID NO: 1816 - DNA, 396 bp, Artificial Sequence
  Synthetic Template Oligonucleotide for IgH DJ Locus
gccttgccagcccgctcagtgctacaccagctcttgtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacaccagctcttgtcgactttgactactggggccagggaaccctggtcaccgtctcctcaggtgagtcctcacaacctctctcctgctttaactctgaagggttttgctgcatttctgtgctacaccagctcttctgatggcgcgagggaggc

SEQ ID NO: 1817 - DNA, 396 bp, Artificial Sequence
  Synthetic Template Oligonucleotide for IgH DJ Locus
gccttgccagcccgctcagaactgccacagctctttgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccacagctcttgtcgactttgactactggggccagggaaccctggtcaccgtctcctcaggtgagtcctcacaacctctctcctgctttaactctgaagggttttgctgcatttctgaactgccacagctcttctgatggcgcgagggaggc

SEQ ID NO: 1818 - DNA, 396 bp, Artificial Sequence
  Synthetic Template Oligonucleotide for IgH DJ Locus
gccttgccagcccgctcagttggactgcagctcttcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgcagctcttgtcgactttgactactggggccagggaaccctggtcaccgtctcctcaggtgagtcctcacaacctctctcctgctttaactctgaagggttttgctgcatttctgttggactgcagctcttctgatggcgcgagggaggc

SEQ ID NO: 1819 - DNA, 402 bp, Artificial Sequence
  Synthetic Template Oligonucleotide for IgH DJ Locus
gccttgccagcccgctcaggtagacaccagctctttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacaccagctcttgtcgactttgactactggggccagggaaccctggtcaccgtctcctcaggtgagtcctcacaacctctctcctgctttaactctgaagggttttgctgcatttctggtagacaccagctcttctgatggcgcgagggaggc

SEQ ID NO: 1820 - DNA, 396 bp, Artificial Sequence
  Synthetic Template Oligonucleotide for IgH DJ Locus
gccttgccagcccgctcagcactgtaccagctctttgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtaccagctcttgtcgactttgactactggggccagggaaccctggtcaccgtctcctcaggtgagtcctcacaacctctctcctgctttaactctgaagggttttgctgcatttctgcactgtaccagctcttctgatggcgcgagggaggc

SEQ ID NO: 1821 - DNA, 381 bp, Artificial Sequence
  Synthetic Template Oligonucleotide for IgH DJ Locus
gccttgccagcccgctcaggatgatcccagctcttcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatcccagctcttgtcgactttgactactggggccagggaaccctggtcaccgtctcctcaggtgagtcctcacaacctctctcctgctttaactctgaagggttttgctgcatttctggatgatcccagctcttctgatggcgcgagggaggc

SEQ ID NO: 1822 - DNA, 381 bp, Artificial Sequence
  Synthetic Template Oligonucleotide for IgH DJ Locus
gccttgccagcccgctcagcgccaatacagctctttgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatacagctcttgtcgactttgactactggggccagggaaccctggtcaccgtctcctcaggtgagtcctcacaacctctctcctgctttaactctgaagggttttgctgcatttctgcgccaatacagctcttctgatggcgcgagggaggc

SEQ ID NO: 1823 - DNA, 381 bp, Artificial Sequence
  Synthetic Template Oligonucleotide for IgH DJ Locus
gccttgccagcccgctcagtcaagcctcagctcttggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctcagctcttgtcgactttgactactggggccagggaaccctggtcaccgtctcctcaggtgagtcctcacaacctctctcctgctttaactctgaagggttttgctgcatttctgtcaagcctcagctcttctgatggcgcgagggaggc

SEQ ID NO: 1824 - DNA, 384 bp, Artificial Sequence
  Synthetic Template Oligonucleotide for IgH DJ Locus
gccttgccagcccgctcagacgtgtgtcagctcttggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtcagctcttgtcgactttgactactggggccagggaaccctggtcaccgtctcctcaggtgagtcctcacaacctctctcctgctttaactctgaagggttttgctgcatttctgacgtgtgtcagctcttctgatggcgcgagggaggc

SEQ ID NO: 1825 - DNA, 385 bp, Artificial Sequence
  Synthetic Template Oligonucleotide for IgH DJ Locus
gccttgccagcccgctcagtccgtctacagctcttagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctacagctcttgtcgactttgactactggggccagggaaccctggtcaccgtctcctcaggtgagtcctcacaacctctctcctgctttaactctgaagggttttgctgcatttctgtccgtctacagctcttctgatggcgcgagggaggc

SEQ ID NO: 1826 - DNA, 388 bp, Artificial Sequence
  Synthetic Template Oligonucleotide for IgH DJ Locus
gccttgccagcccgctcagaagagctgcagctcttgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgcagctcttgtcgactttgactactggggccagggaaccctggtcaccgtctcctcaggtgagtcctcacaacctctctcctgctttaactctgaagggttttgctgcatttctgaagagctgcagctcttctgatggcgcgagggaggc

SEQ ID NO: 1827 - DNA, 385 bp, Artificial Sequence
  Synthetic Template Oligonucleotide for IgH DJ Locus
gccttgccagcccgctcagtatcgctccagctcttgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctccagctcttgtcgactttgactactggggccagggaaccctggtcaccgtctcctcaggtgagtcctcacaacctctctcctgctttaactctgaagggttttgctgcatttctgtatcgctccagctcttctgatggcgcgagggaggc

SEQ ID NO: 1828 - DNA, 385 bp, Artificial Sequence
  Synthetic Template Oligonucleotide for IgH DJ Locus
gccttgccagcccgctcagtcagatgccagctcttgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgccagctcttgtcgactttgactactggggccagggaaccctggtcaccgtctcctcaggtgagtcctcacaacctctctcctgctttaactctgaagggttttgctgcatttctgtcagatgccagctcttctgatggcgcgagggaggc

SEQ ID NO: 1829 - DNA, 383 bp, Artificial Sequence
  Synthetic Template Oligonucleotide for IgH DJ Locus
gccttgccagcccgctcaggtgtagcacagctcttaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcacagctcttgtcgactttgactactggggccagggaaccctggtcaccgtctcctcaggtgagtcctcacaacctctctcctgctttaactctgaagggttttgctgcatttctggtgtagcacagctcttctgatggcgcgagggaggc

SEQ ID NO: 1830 - DNA, 386 bp, Artificial Sequence
  Synthetic Template Oligonucleotide for IgH DJ Locus
gccttgccagcccgctcagtggcagttcagctcttaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttcagctcttgtcgactttgactactggggccagggaaccctggtcaccgtctcctcaggtgagtcctcacaacctctctcctgctttaactctgaagggttttgctgcatttctgtggcagttcagctcttctgatggcgcgagggaggc

SEQ ID NO: 1831 - DNA, 386 bp, Artificial Sequence
  Synthetic Template Oligonucleotide for IgH DJ Locus
gccttgccagcccgctcagcagtccaacagctctttgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaacagctcttgtcgactttgactactggggccagggaaccctggtcaccgtctcctcaggtgagtcctcacaacctctctcctgctttaactctgaagggttttgctgcatttctgcagtccaacagctcttctgatggcgcgagggaggc

SEQ ID NO: 1832 - DNA, 383 bp, Artificial Sequence
  Synthetic Template Oligonucleotide for IgH DJ Locus
gccttgccagcccgctcagtacgtacgcagctcttcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgcagctcttgtcgactttgactactggggccagggaaccctggtcaccgtctcctcaggtgagtcctcacaacctctctcctgctttaactctgaagggttttgctgcatttctgtacgtacgcagctcttctgatggcgcgagggaggc

SEQ ID NO: 1833 - DNA, 377 bp, Artificial Sequence
  Synthetic Template Oligonucleotide for IgH DJ Locus
gccttgccagcccgctcagagtaccgacagctcttagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgacagctcttgtcgactttgactactggggccagggaaccctggtcaccgtctcctcaggtgagtcctcacaacctctctcctgctttaactctgaagggttttgctgcatttctgagtaccgacagctcttctgatggcgcgagggaggc

SEQ ID NO: 1834 - DNA, 382 bp, Artificial Sequence
  Synthetic Template Oligonucleotide for IgH DJ Locus
gccttgccagcccgctcaggacactctgagcgatagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctgagcgatagtcgactggttcgacccctggggccagggaaccctggtcaccgtctcctcaggtgagtcctcaccaccccctctctgagtccacttagggagactcagcttgccaggacactctgagcgatactgatggcgcgagggaggc

SEQ ID NO: 1835 - DNA, 382 bp, Artificial Sequence
  Synthetic Template Oligonucleotide for IgH DJ Locus
gccttgccagcccgctcagttcggaacgagcgataggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacgagcgatagtcgactggttcgacccctggggccagggaaccctggtcaccgtctcctcaggtgagtcctcaccaccccctctctgagtccacttagggagactcagcttgccagttcggaacgagcgatactgatggcgcgagggaggc

SEQ ID NO: 1836 - DNA, 382 bp, Artificial Sequence
  Synthetic Template Oligonucleotide for IgH DJ Locus
gccttgccagcccgctcagaagtaacggagcgataggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacggagcgatagtcgactggttcgacccctggggccagggaaccctggtcaccgtctcctcaggtgagtcctcaccaccccctctctgagtccacttagggagactcagcttgccagaagtaacggagcgatactgatggcgcgagggaggc

SEQ ID NO: 1837 - DNA, 382 bp, Artificial Sequence
  Synthetic Template Oligonucleotide for IgH DJ Locus
gccttgccagcccgctcaggtctcctagagcgatagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctagagcgatagtcgactggttcgacccctggggccagggaaccctggtcaccgtctcctcaggtgagtcctcaccaccccctctctgagtccacttagggagactcagcttgccaggtctcctagagcgatactgatggcgcgagggaggc

SEQ ID NO: 1838 - DNA, 385 bp, Artificial Sequence
  Synthetic Template Oligonucleotide for IgH DJ Locus
gccttgccagcccgctcagagagtgtcgagcgataaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcgagcgatagtcgactggttcgacccctggggccagggaaccctggtcaccgtctcctcaggtgagtcctcaccaccccctctctgagtccacttagggagactcagcttgccagagagtgtcgagcgatactgatggcgcgagggaggc

SEQ ID NO: 1839 - DNA, 396 bp, Artificial Sequence
  Synthetic Template Oligonucleotide for IgH DJ Locus
gccttgccagcccgctcaggttccgaagagcgataaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaagagcgatagtcgactggttcgacccctggggccagggaaccctggtcaccgtctcctcaggtgagtcctcaccaccccctctctgagtccacttagggagactcagcttgccaggttccgaagagcgatactgatggcgcgagggaggc

SEQ ID NO: 1840 - DNA, 396 bp, Artificial Sequence
  Synthetic Template Oligonucleotide for IgH DJ Locus
gccttgccagcccgctcagcgttacttgagcgataaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttgagcgatagtcgactggttcgacccctggggccagggaaccctggtcaccgtctcctcaggtgagtcctcaccaccccctctctgagtccacttagggagactcagcttgccagcgttacttgagcgatactgatggcgcgagggaggc

SEQ ID NO: 1841 - DNA, 396 bp, Artificial Sequence
  Synthetic Template Oligonucleotide for IgH DJ Locus
gccttgccagcccgctcagtaggagacgagcgataaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacgagcgatagtcgactggttcgacccctggggccagggaaccctggtcaccgtctcctcaggtgagtcctcaccaccccctctctgagtccacttagggagactcagcttgccagtaggagacgagcgatactgatggcgcgagggaggc

SEQ ID NO: 1842 - DNA, 393 bp, Artificial Sequence
  Synthetic Template Oligonucleotide for IgH DJ Locus
gccttgccagcccgctcaggtgtctacgagcgataagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacgagcgatagtcgactggttcgacccctggggccagggaaccctggtcaccgtctcctcaggtgagtcctcaccaccccctctctgagtccacttagggagactcagcttgccaggtgtctacgagcgatactgatggcgcgagggaggc

SEQ ID NO: 1843 - DNA, 396 bp, Artificial Sequence
  Synthetic Template Oligonucleotide for IgH DJ Locus
gccttgccagcccgctcagtgctacacgagcgatagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacgagcgatagtcgactggttcgacccctggggccagggaaccctggtcaccgtctcctcaggtgagtcctcaccaccccctctctgagtccacttagggagactcagcttgccagtgctacacgagcgatactgatggcgcgagggaggc

SEQ ID NO: 1844 - DNA, 396 bp, Artificial Sequence
  Synthetic Template Oligonucleotide for IgH DJ Locus
gccttgccagcccgctcagaactgccagagcgatatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccagagcgatagtcgactggttcgacccctggggccagggaaccctggtcaccgtctcctcaggtgagtcctcaccaccccctctctgagtccacttagggagactcagcttgccagaactgccagagcgatactgatggcgcgagggaggc

SEQ ID NO: 1845 - DNA, 396 bp, Artificial Sequence
  Synthetic Template Oligonucleotide for IgH DJ Locus
gccttgccagcccgctcagttggactggagcgatacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactggagcgatagtcgactggttcgacccctggggccagggaaccctggtcaccgtctcctcaggtgagtcctcaccaccccctctctgagtccacttagggagactcagcttgccagttggactggagcgatactgatggcgcgagggaggc

SEQ ID NO: 1846 - DNA, 402 bp, Artificial Sequence
  Synthetic Template Oligonucleotide for IgH DJ Locus
gccttgccagcccgctcaggtagacacgagcgatatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacgagcgatagtcgactggttcgacccctggggccagggaaccctggtcaccgtctcctcaggtgagtcctcaccaccccctctctgagtccacttagggagactcagcttgccaggtagacacgagcgatactgatggcgcgagggaggc

SEQ ID NO: 1847 - DNA, 396 bp, Artificial Sequence
  Synthetic Template Oligonucleotide for IgH DJ Locus
gccttgccagcccgctcagcactgtacgagcgatatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacgagcgatagtcgactggttcgacccctggggccagggaaccctggtcaccgtctcctcaggtgagtcctcaccaccccctctctgagtccacttagggagactcagcttgccagcactgtacgagcgatactgatggcgcgagggaggc

SEQ ID NO: 1848 - DNA, 381 bp, Artificial Sequence
  Synthetic Template Oligonucleotide for IgH DJ Locus
gccttgccagcccgctcaggatgatccgagcgatacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccgagcgatagtcgactggttcgacccctggggccagggaaccctggtcaccgtctcctcaggtgagtcctcaccaccccctctctgagtccacttagggagactcagcttgccaggatgatccgagcgatactgatggcgcgagggaggc

SEQ ID NO: 1849 - DNA, 381 bp, Artificial Sequence
  Synthetic Template Oligonucleotide for IgH DJ Locus
gccttgccagcccgctcagcgccaatagagcgatatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatagagcgatagtcgactggttcgacccctggggccagggaaccctggtcaccgtctcctcaggtgagtcctcaccaccccctctctgagtccacttagggagactcagcttgccagcgccaatagagcgatactgatggcgcgagggaggc

SEQ ID NO: 1850 - DNA, 381 bp, Artificial Sequence
  Synthetic Template Oligonucleotide for IgH DJ Locus
gccttgccagcccgctcagtcaagcctgagcgataggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctgagcgatagtcgactggttcgacccctggggccagggaaccctggtcaccgtctcctcaggtgagtcctcaccaccccctctctgagtccacttagggagactcagcttgccagtcaagcctgagcgatactgatggcgcgagggaggc

SEQ ID NO: 1851 - DNA, 384 bp, Artificial Sequence
  Synthetic Template Oligonucleotide for IgH DJ Locus
gccttgccagcccgctcagacgtgtgtgagcgataggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtgagcgatagtcgactggttcgacccctggggccagggaaccctggtcaccgtctcctcaggtgagtcctcaccaccccctctctgagtccacttagggagactcagcttgccagacgtgtgtgagcgatactgatggcgcgagggaggc

SEQ ID NO: 1852 - DNA, 385 bp, Artificial Sequence
  Synthetic Template Oligonucleotide for IgH DJ Locus
gccttgccagcccgctcagtccgtctagagcgataagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctagagcgatagtcgactggttcgacccctggggccagggaaccctggtcaccgtctcctcaggtgagtcctcaccaccccctctctgagtccacttagggagactcagcttgccagtccgtctagagcgatactgatggcgcgagggaggc

SEQ ID NO: 1853 - DNA, 388 bp, Artificial Sequence
  Synthetic Template Oligonucleotide for IgH DJ Locus
gccttgccagcccgctcagaagagctggagcgatagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctggagcgatagtcgactggttcgacccctggggccagggaaccctggtcaccgtctcctcaggtgagtcctcaccaccccctctctgagtccacttagggagactcagcttgccagaagagctggagcgatactgatggcgcgagggaggc

SEQ ID NO: 1854 - DNA, 385 bp, Artificial Sequence
  Synthetic Template Oligonucleotide for IgH DJ Locus
gccttgccagcccgctcagtatcgctcgagcgatagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcgagcgatagtcgactggttcgacccctggggccagggaaccctggtcaccgtctcctcaggtgagtcctcaccaccccctctctgagtccacttagggagactcagcttgccagtatcgctcgagcgatactgatggcgcgagggaggc

SEQ ID NO: 1855 - DNA, 385 bp, Artificial Sequence
  Synthetic Template Oligonucleotide for IgH DJ Locus
gccttgccagcccgctcagtcagatgcgagcgatagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcgagcgatagtcgactggttcgacccctggggccagggaaccctggtcaccgtctcctcaggtgagtcctcaccaccccctctctgagtccacttagggagactcagcttgccagtcagatgcgagcgatactgatggcgcgagggaggc

SEQ ID NO: 1856 - DNA, 383 bp, Artificial Sequence
  Synthetic Template Oligonucleotide for IgH DJ Locus
gccttgccagcccgctcaggtgtagcagagcgataaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcagagcgatagtcgactggttcgacccctggggccagggaaccctggtcaccgtctcctcaggtgagtcctcaccaccccctctctgagtccacttagggagactcagcttgccaggtgtagcagagcgatactgatggcgcgagggaggc

SEQ ID NO: 1857 - DNA, 386 bp, Artificial Sequence
  Synthetic Template Oligonucleotide for IgH DJ Locus
gccttgccagcccgctcagtggcagttgagcgataaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttgagcgatagtcgactggttcgacccctggggccagggaaccctggtcaccgtctcctcaggtgagtcctcaccaccccctctctgagtccacttagggagactcagcttgccagtggcagttgagcgatactgatggcgcgagggaggc

SEQ ID NO: 1858 - DNA, 386 bp, Artificial Sequence
  Synthetic Template Oligonucleotide for IgH DJ Locus
gccttgccagcccgctcagcagtccaagagcgatatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaagagcgatagtcgactggttcgacccctggggccagggaaccctggtcaccgtctcctcaggtgagtcctcaccaccccctctctgagtccacttagggagactcagcttgccagcagtccaagagcgatactgatggcgcgagggaggc

SEQ ID NO: 1859 - DNA, 383 bp, Artificial Sequence
  Synthetic Template Oligonucleotide for IgH DJ Locus
gccttgccagcccgctcagtacgtacggagcgatacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacggagcgatagtcgactggttcgacccctggggccagggaaccctggtcaccgtctcctcaggtgagtcctcaccaccccctctctgagtccacttagggagactcagcttgccagtacgtacggagcgatactgatggcgcgagggaggc

SEQ ID NO: 1860 - DNA, 377 bp, Artificial Sequence
  Synthetic Template Oligonucleotide for IgH DJ Locus
gccttgccagcccgctcagagtaccgagagcgataagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgagagcgatagtcgactggttcgacccctggggccagggaaccctggtcaccgtctcctcaggtgagtcctcaccaccccctctctgagtccacttagggagactcagcttgccagagtaccgagagcgatactgatggcgcgagggaggc

SEQ ID NO: 1861 - DNA, 382 bp, Artificial Sequence
  Synthetic Template Oligonucleotide for IgH DJ Locus
gccttgccagcccgctcaggacactctgcatctgagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctgcatctgagtcgactactactactactacatggacgtctggggcaaagggaccacggtcaccgtctcctcaggtaagaatggccactctagggcctttgttttctgctactgccgacactctgcatctgactgatggcgcgagggaggc

SEQ ID NO: 1862 - DNA, 382 bp, Artificial Sequence
  Synthetic Template Oligonucleotide for IgH DJ Locus
gccttgccagcccgctcagttcggaacgcatctgaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacgcatctgagtcgactactactactactacatggacgtctggggcaaagggaccacggtcaccgtctcctcaggtaagaatggccactctagggcctttgttttctgctactgccttcggaacgcatctgactgatggcgcgagggaggc

SEQ ID NO: 1863 - DNA, 382 bp, Artificial Sequence
  Synthetic Template Oligonucleotide for IgH DJ Locus
gccttgccagcccgctcagaagtaacggcatctgaggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacggcatctgagtcgactactactactactacatggacgtctggggcaaagggaccacggtcaccgtctcctcaggtaagaatggccactctagggcctttgttttctgctactgccaagtaacggcatctgactgatggcgcgagggaggc

SEQ ID NO: 1864 - DNA, 382 bp, Artificial Sequence
  Synthetic Template Oligonucleotide for IgH DJ Locus
gccttgccagcccgctcaggtctcctagcatctgagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctagcatctgagtcgactactactactactacatggacgtctggggcaaagggaccacggtcaccgtctcctcaggtaagaatggccactctagggcctttgttttctgctactgccgtctcctagcatctgactgatggcgcgagggaggc

SEQ ID NO: 1865 - DNA, 385 bp, Artificial Sequence
  Synthetic Template Oligonucleotide for IgH DJ Locus
gccttgccagcccgctcagagagtgtcgcatctgaaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcgcatctgagtcgactactactactactacatggacgtctggggcaaagggaccacggtcaccgtctcctcaggtaagaatggccactctagggcctttgttttctgctactgccagagtgtcgcatctgactgatggcgcgagggaggc

SEQ ID NO: 1866 - DNA, 396 bp, Artificial Sequence
  Synthetic Template Oligonucleotide for IgH DJ Locus
gccttgccagcccgctcaggttccgaagcatctgaaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaagcatctgagtcgactactactactactacatggacgtctggggcaaagggaccacggtcaccgtctcctcaggtaagaatggccactctagggcctttgttttctgctactgccgttccgaagcatctgactgatggcgcgagggaggc

SEQ ID NO: 1867 - DNA, 396 bp, Artificial Sequence
  Synthetic Template Oligonucleotide for IgH DJ Locus
gccttgccagcccgctcagcgttacttgcatctgaaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttgcatctgagtcgactactactactactacatggacgtctggggcaaagggaccacggtcaccgtctcctcaggtaagaatggccactctagggcctttgttttctgctactgcccgttacttgcatctgactgatggcgcgagggaggc

SEQ ID NO: 1868 - DNA, 396 bp, Artificial Sequence
  Synthetic Template Oligonucleotide for IgH DJ Locus
gccttgccagcccgctcagtaggagacgcatctgaaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacgcatctgagtcgactactactactactacatggacgtctggggcaaagggaccacggtcaccgtctcctcaggtaagaatggccactctagggcctttgttttctgctactgcctaggagacgcatctgactgatggcgcgagggaggc

SEQ ID NO: 1869 - DNA, 393 bp, Artificial Sequence
  Synthetic Template Oligonucleotide for IgH DJ Locus
gccttgccagcccgctcaggtgtctacgcatctgaagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacgcatctgagtcgactactactactactacatggacgtctggggcaaagggaccacggtcaccgtctcctcaggtaagaatggccactctagggcctttgttttctgctactgccgtgtctacgcatctgactgatggcgcgagggaggc

SEQ ID NO: 1870 - DNA, 396 bp, Artificial Sequence
  Synthetic Template Oligonucleotide for IgH DJ Locus
gccttgccagcccgctcagtgctacacgcatctgagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacgcatctgagtcgactactactactactacatggacgtctggggcaaagggaccacggtcaccgtctcctcaggtaagaatggccactctagggcctttgttttctgctactgcctgctacacgcatctgactgatggcgcgagggaggc

SEQ ID NO: 1871 - DNA, 396 bp, Artificial Sequence
  Synthetic Template Oligonucleotide for IgH DJ Locus
gccttgccagcccgctcagaactgccagcatctgatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccagcatctgagtcgactactactactactacatggacgtctggggcaaagggaccacggtcaccgtctcctcaggtaagaatggccactctagggcctttgttttctgctactgccaactgccagcatctgactgatggcgcgagggaggc

SEQ ID NO: 1872 - DNA, 396 bp, Artificial Sequence
  Synthetic Template Oligonucleotide for IgH DJ Locus
gccttgccagcccgctcagttggactggcatctgacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactggcatctgagtcgactactactactactacatggacgtctggggcaaagggaccacggtcaccgtctcctcaggtaagaatggccactctagggcctttgttttctgctactgccttggactggcatctgactgatggcgcgagggaggc

SEQ ID NO: 1873 - DNA, 402 bp, Artificial Sequence
  Synthetic Template Oligonucleotide for IgH DJ Locus
gccttgccagcccgctcaggtagacacgcatctgatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacgcatctgagtcgactactactactactacatggacgtctggggcaaagggaccacggtcaccgtctcctcaggtaagaatggccactctagggcctttgttttctgctactgccgtagacacgcatctgactgatggcgcgagggaggc

SEQ ID NO: 1874 - DNA, 396 bp, Artificial Sequence
  Synthetic Template Oligonucleotide for IgH DJ Locus
gccttgccagcccgctcagcactgtacgcatctgatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacgcatctgagtcgactactactactactacatggacgtctggggcaaagggaccacggtcaccgtctcctcaggtaagaatggccactctagggcctttgttttctgctactgcccactgtacgcatctgactgatggcgcgagggaggc

SEQ ID NO: 1875 - DNA, 381 bp, Artificial Sequence
  Synthetic Template Oligonucleotide for IgH DJ Locus
gccttgccagcccgctcaggatgatccgcatctgacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccgcatctgagtcgactactactactactacatggacgtctggggcaaagggaccacggtcaccgtctcctcaggtaagaatggccactctagggcctttgttttctgctactgccgatgatccgcatctgactgatggcgcgagggaggc

SEQ ID NO: 1876 - DNA, 381 bp, Artificial Sequence
  Synthetic Template Oligonucleotide for IgH DJ Locus
gccttgccagcccgctcagcgccaatagcatctgatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatagcatctgagtcgactactactactactacatggacgtctggggcaaagggaccacggtcaccgtctcctcaggtaagaatggccactctagggcctttgttttctgctactgcccgccaatagcatctgactgatggcgcgagggaggc

SEQ ID NO: 1877 - DNA, 381 bp, Artificial Sequence
  Synthetic Template Oligonucleotide for IgH DJ Locus
gccttgccagcccgctcagtcaagcctgcatctgaggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctgcatctgagtcgactactactactactacatggacgtctggggcaaagggaccacggtcaccgtctcctcaggtaagaatggccactctagggcctttgttttctgctactgcctcaagcctgcatctgactgatggcgcgagggaggc

SEQ ID NO: 1878 - DNA, 384 bp, Artificial Sequence
  Synthetic Template Oligonucleotide for IgH DJ Locus
gccttgccagcccgctcagacgtgtgtgcatctgaggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtgcatctgagtcgactactactactactacatggacgtctggggcaaagggaccacggtcaccgtctcctcaggtaagaatggccactctagggcctttgttttctgctactgccacgtgtgtgcatctgactgatggcgcgagggaggc

SEQ ID NO: 1879 - DNA, 385 bp, Artificial Sequence
  Synthetic Template Oligonucleotide for IgH DJ Locus
gccttgccagcccgctcagtccgtctagcatctgaagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctagcatctgagtcgactactactactactacatggacgtctggggcaaagggaccacggtcaccgtctcctcaggtaagaatggccactctagggcctttgttttctgctactgcctccgtctagcatctgactgatggcgcgagggaggc

SEQ ID NO: 1880 - DNA, 388 bp, Artificial Sequence
  Synthetic Template Oligonucleotide for IgH DJ Locus
gccttgccagcccgctcagaagagctggcatctgagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctggcatctgagtcgactactactactactacatggacgtctggggcaaagggaccacggtcaccgtctcctcaggtaagaatggccactctagggcctttgttttctgctactgccaagagctggcatctgactgatggcgcgagggaggc

SEQ ID NO: 1881 - DNA, 385 bp, Artificial Sequence
  Synthetic Template Oligonucleotide for IgH DJ Locus
gccttgccagcccgctcagtatcgctcgcatctgagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcgcatctgagtcgactactactactactacatggacgtctggggcaaagggaccacggtcaccgtctcctcaggtaagaatggccactctagggcctttgttttctgctactgcctatcgctcgcatctgactgatggcgcgagggaggc

SEQ ID NO: 1882 - DNA, 385 bp, Artificial Sequence
  Synthetic Template Oligonucleotide for IgH DJ Locus
gccttgccagcccgctcagtcagatgcgcatctgagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcgcatctgagtcgactactactactactacatggacgtctggggcaaagggaccacggtcaccgtctcctcaggtaagaatggccactctagggcctttgttttctgctactgcctcagatgcgcatctgactgatggcgcgagggaggc

SEQ ID NO: 1883 - DNA, 383 bp, Artificial Sequence
  Synthetic Template Oligonucleotide for IgH DJ Locus
gccttgccagcccgctcaggtgtagcagcatctgaaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcagcatctgagtcgactactactactactacatggacgtctggggcaaagggaccacggtcaccgtctcctcaggtaagaatggccactctagggcctttgttttctgctactgccgtgtagcagcatctgactgatggcgcgagggaggc

SEQ ID NO: 1884 - DNA, 386 bp, Artificial Sequence
  Synthetic Template Oligonucleotide for IgH DJ Locus
gccttgccagcccgctcagtggcagttgcatctgaaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttgcatctgagtcgactactactactactacatggacgtctggggcaaagggaccacggtcaccgtctcctcaggtaagaatggccactctagggcctttgttttctgctactgcctggcagttgcatctgactgatggcgcgagggaggc

SEQ ID NO: 1885 - DNA, 386 bp, Artificial Sequence
  Synthetic Template Oligonucleotide for IgH DJ Locus
gccttgccagcccgctcagcagtccaagcatctgatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaagcatctgagtcgactactactactactacatggacgtctggggcaaagggaccacggtcaccgtctcctcaggtaagaatggccactctagggcctttgttttctgctactgcccagtccaagcatctgactgatggcgcgagggaggc

SEQ ID NO: 1886 - DNA, 383 bp, Artificial Sequence
  Synthetic Template Oligonucleotide for IgH DJ Locus
gccttgccagcccgctcagtacgtacggcatctgacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacggcatctgagtcgactactactactactacatggacgtctggggcaaagggaccacggtcaccgtctcctcaggtaagaatggccactctagggcctttgttttctgctactgcctacgtacggcatctgactgatggcgcgagggaggc

SEQ ID NO: 1887 - DNA, 377 bp, Artificial Sequence
  Synthetic Template Oligonucleotide for IgH DJ Locus
gccttgccagcccgctcagagtaccgagcatctgaagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgagcatctgagtcgactactactactactacatggacgtctggggcaaagggaccacggtcaccgtctcctcaggtaagaatggccactctagggcctttgttttctgctactgccagtaccgagcatctgactgatggcgcgagggaggc

SEQ ID NO: 1888 - DNA, 495 bp, Artificial Sequence
  Synthetic Template Oligonucleotide for IgH VJ Locus
gcctccctcgcgccatcagagagtgtccttggttacttgcctggcccagtacacctggctccccgctatccccagacagcagactcacctgaggagacggtgaccagggtgccctggccccagtgctggaagtatgtcgacagagtgtccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccagagtgtccttggttactgagcgggctggcaaggc

SEQ ID NO: 1889 - DNA, 495 bp, Artificial Sequence
  Synthetic Template Oligonucleotide for IgH VJ Locus
gcctccctcgcgccatcagagagtgtcacctcttgcttgcctggcccagtacacctggctccccgctatccccagacagcagactcacctgaggagacggtgaccagggtgccctggccccagtgctggaagtatgtcgacagagtgtcacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccagagtgtcacctcttgctgagcgggctggcaaggc

SEQ ID NO: 1890 - DNA, 495 bp, Artificial Sequence
  Synthetic Template Oligonucleotide for IgH VJ Locus
gcctccctcgcgccatcagagagtgtcctgattctcttgcctggcccagtacacctggctccccgctatccccagacagcagactcacctgaggagacggtgaccagggtgccctggccccagtgctggaagtatgtcgacagagtgtcctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccagagtgtcctgattctctgagcgggctggcaaggc

SEQ ID NO: 1891 - DNA, 495 bp, Artificial Sequence
  Synthetic Template Oligonucleotide for IgH VJ Locus
gcctccctcgcgccatcagagagtgtcagtaccgacttgcctggcccagtacacctggctccccgctatccccagacagcagactcacctgaggagacggtgaccagggtgccctggccccagtgctggaagtatgtcgacagagtgtcagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccagagtgtcagtaccgactgagcgggctggcaaggc

SEQ ID NO: 1892 - DNA, 495 bp, Artificial Sequence
  Synthetic Template Oligonucleotide for IgH VJ Locus
gcctccctcgcgccatcagagagtgtcatccatggcttgcctggcccagtacacctggctccccgctatccccagacagcagactcacctgaggagacggtgaccagggtgccctggccccagtgctggaagtatgtcgacagagtgtcatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccagagtgtcatccatggctgagcgggctggcaaggc

SEQ ID NO: 1893 - DNA, 495 bp, Artificial Sequence
  Synthetic Template Oligonucleotide for IgH VJ Locus
gcctccctcgcgccatcagagagtgtcgtagcagtcttgcctggcccagtacacctggctccccgctatccccagacagcagactcacctgaggagacggtgaccagggtgccctggccccagtgctggaagtatgtcgacagagtgtcgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcagagtgtcgtagcagtctgagcgggctggcaaggc

SEQ ID NO: 1894 - DNA, 495 bp, Artificial Sequence
  Synthetic Template Oligonucleotide for IgH VJ Locus
gcctccctcgcgccatcagagagtgtcatcttcgtcttgcctggcccagtacacctggctccccgctatccccagacagcagactcacctgaggagacggtgaccagggtgccctggccccagtgctggaagtatgtcgacagagtgtcatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccagagtgtcatcttcgtctgagcgggctggcaaggc

SEQ ID NO: 1895 - DNA, 495 bp, Artificial Sequence
  Synthetic Template Oligonucleotide for IgH VJ Locus
gcctccctcgcgccatcagagagtgtctccacagtcttgcctggcccagtacacctggctccccgctatccccagacagcagactcacctgaggagacggtgaccagggtgccctggccccagtgctggaagtatgtcgacagagtgtctccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccagagtgtctccacagtctgagcgggctggcaaggc

SEQ ID NO: 1896 - DNA, 495 bp, Artificial Sequence
  Synthetic Template Oligonucleotide for IgH VJ Locus
gcctccctcgcgccatcagagagtgtcagctagtgcttgcctggcccagtacacctggctccccgctatccccagacagcagactcacctgaggagacggtgaccagggtgccctggccccagtgctggaagtatgtcgacagagtgtcagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccagagtgtcagctagtgctgagcgggctggcaaggc

SEQ ID NO: 1897 - DNA, 495 bp, Artificial Sequence
  Synthetic Template Oligonucleotide for IgH VJ Locus
gcctccctcgcgccatcagagagtgtctaaccaagcttgcctggcccagtacacctggctccccgctatccccagacagcagactcacctgaggagacggtgaccagggtgccctggccccagtgctggaagtatgtcgacagagtgtctaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccagagtgtctaaccaagctgagcgggctggcaaggc

SEQ ID NO: 1898 - DNA, 495 bp, Artificial Sequence
  Synthetic Template Oligonucleotide for IgH VJ Locus
gcctccctcgcgccatcagagagtgtccaagaggtcttgcctggcccagtacacctggctccccgctatccccagacagcagactcacctgaggagacggtgaccagggtgccctggccccagtgctggaagtatgtcgacagagtgtccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccagagtgtccaagaggtctgagcgggctggcaaggc

SEQ ID NO: 1899 - DNA, 495 bp, Artificial Sequence
  Synthetic Template Oligonucleotide for IgH VJ Locus
gcctccctcgcgccatcagagagtgtcagttgacccttgcctggcccagtacacctggctccccgctatccccagacagcagactcacctgaggagacggtgaccagggtgccctggccccagtgctggaagtatgtcgacagagtgtcagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaaagagtgtcagttgaccctgagcgggctggcaaggc

SEQ ID NO: 1900 - DNA, 495 bp, Artificial Sequence
  Synthetic Template Oligonucleotide for IgH VJ Locus
gcctccctcgcgccatcagagagtgtccagcatatcttgcctggcccagtacacctggctccccgctatccccagacagcagactcacctgaggagacggtgaccagggtgccctggccccagtgctggaagtatgtcgacagagtgtccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaaagagtgtccagcatatctgagcgggctggcaaggc

SEQ ID NO: 1901 - DNA, 495 bp, Artificial Sequence
  Synthetic Template Oligonucleotide for IgH VJ Locus
gcctccctcgcgccatcagagagtgtcgcaggattcttgcctggcccagtacacctggctccccgctatccccagacagcagactcacctgaggagacggtgaccagggtgccctggccccagtgctggaagtatgtcgacagagtgtcgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataaagagtgtcgcaggattctgagcgggctggcaaggc

SEQ ID NO: 1902 - DNA, 495 bp, Artificial Sequence
  Synthetic Template Oligonucleotide for IgH VJ Locus
gcctccctcgcgccatcagagagtgtcgtccattccttgcctggcccagtacacctggctccccgctatccccagacagcagactcacctgaggagacggtgaccagggtgccctggccccagtgctggaagtatgtcgacagagtgtcgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccagagtgtcgtccattcctgagcgggctggcaaggc

SEQ ID NO: 1903 - DNA, 495 bp, Artificial Sequence
  Synthetic Template Oligonucleotide for IgH VJ Locus
gcctccctcgcgccatcagagagtgtcgcataactcttgcctggcccagtacacctggctccccgctatccccagacagcagactcacctgaggagacggtgaccagggtgccctggccccagtgctggaagtatgtcgacagagtgtcgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacagagtgtcgcataactctgagcgggctggcaaggc

SEQ ID NO: 1904 - DNA, 495 bp, Artificial Sequence
  Synthetic Template Oligonucleotide for IgH VJ Locus
gcctccctcgcgccatcagagagtgtcatatgctgcttgcctggcccagtacacctggctccccgctatccccagacagcagactcacctgaggagacggtgaccagggtgccctggccccagtgctggaagtatgtcgacagagtgtcatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccagagtgtcatatgctgctgagcgggctggcaaggc

SEQ ID NO: 1905 - DNA, 495 bp, Artificial Sequence
  Synthetic Template Oligonucleotide for IgH VJ Locus
gcctccctcgcgccatcagagagtgtcaatcctgccttgcctggcccagtacacctggctccccgctatccccagacagcagactcacctgaggagacggtgaccagggtgccctggccccagtgctggaagtatgtcgacagagtgtcaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcagagtgtcaatcctgcctgagcgggctggcaaggc

SEQ ID NO: 1906 - DNA, 495 bp, Artificial Sequence
  Synthetic Template Oligonucleotide for IgH VJ Locus
gcctccctcgcgccatcagagagtgtctgagacctcttgcctggcccagtacacctggctccccgctatccccagacagcagactcacctgaggagacggtgaccagggtgccctggccccagtgctggaagtatgtcgacagagtgtctgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgagagtgtctgagacctctgagcgggctggcaaggc

SEQ ID NO: 1907 - DNA, 495 bp, Artificial Sequence
  Synthetic Template Oligonucleotide for IgH VJ Locus
gcctccctcgcgccatcagagagtgtcgaatggaccttgcctggcccagtacacctggctccccgctatccccagacagcagactcacctgaggagacggtgaccagggtgccctggccccagtgctggaagtatgtcgacagagtgtcgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccagagtgtcgaatggacctgagcgggctggcaaggc

SEQ ID NO: 1908 - DNA, 495 bp, Artificial Sequence
  Synthetic Template Oligonucleotide for IgH VJ Locus
gcctccctcgcgccatcagagagtgtccacatggacttgcctggcccagtacacctggctccccgctatccccagacagcagactcacctgaggagacggtgaccagggtgccctggccccagtgctggaagtatgtcgacagagtgtccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccagagtgtccacatggactgagcgggctggcaaggc

SEQ ID NO: 1909 - DNA, 495 bp, Artificial Sequence
  Synthetic Template Oligonucleotide for IgH VJ Locus
gcctccctcgcgccatcagagagtgtcttgaccatcttgcctggcccagtacacctggctccccgctatccccagacagcagactcacctgaggagacggtgaccagggtgccctggccccagtgctggaagtatgtcgacagagtgtcttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccagagtgtcttgaccatctgagcgggctggcaaggc

SEQ ID NO: 1910 - DNA, 495 bp, Artificial Sequence
  Synthetic Template Oligonucleotide for IgH VJ Locus
gcctccctcgcgccatcagagagtgtcaagccatccttgcctggcccagtacacctggctccccgctatccccagacagcagactcacctgaggagacggtgaccagggtgccctggccccagtgctggaagtatgtcgacagagtgtcaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccagagtgtcaagccatcctgagcgggctggcaaggc

SEQ ID NO: 1911 - DNA, 495 bp, Artificial Sequence
  Synthetic Template Oligonucleotide for IgH VJ Locus
gcctccctcgcgccatcagagagtgtctccatgtgcttgcctggcccagtacacctggctccccgctatccccagacagcagactcacctgaggagacggtgaccagggtgccctggccccagtgctggaagtatgtcgacagagtgtctccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccagagtgtctccatgtgctgagcgggctggcaaggc

SEQ ID NO: 1912 - DNA, 495 bp, Artificial Sequence
  Synthetic Template Oligonucleotide for IgH VJ Locus
gcctccctcgcgccatcagagagtgtccaagtcaccttgcctggcccagtacacctggctccccgctatccccagacagcagactcacctgaggagacggtgaccagggtgccctggccccagtgctggaagtatgtcgacagagtgtccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccagagtgtccaagtcacctgagcgggctggcaaggc

SEQ ID NO: 1913 - DNA, 495 bp, Artificial Sequence
  Synthetic Template Oligonucleotide for IgH VJ Locus
gcctccctcgcgccatcagagagtgtcctgcaatccttgcctggcccagtacacctggctccccgctatccccagacagcagactcacctgaggagacggtgaccagggtgccctggccccagtgctggaagtatgtcgacagagtgtcctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccagagtgtcctgcaatcctgagcgggctggcaaggc

SEQ ID NO: 1914 - DNA, 495 bp, Artificial Sequence
  Synthetic Template Oligonucleotide for IgH VJ Locus
gcctccctcgcgccatcagagagtgtcatcgacgacttgcctggcccagtacacctggctccccgctatccccagacagcagactcacctgaggagacggtgaccagggtgccctggccccagtgctggaagtatgtcgacagagtgtcatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccagagtgtcatcgacgactgagcgggctggcaaggc

SEQ ID NO: 1915 - DNA, 495 bp, Artificial Sequence
  Synthetic Template Oligonucleotide for IgH VJ Locus
gcctccctcgcgccatcagagagtgtcacagactgcttgcctggcccagtacacctggctccccgctatccccagacagcagactcacctgaggagacggtgaccagggtgccctggccccagtgctggaagtatgtcgacagagtgtcacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaaagagtgtcacagactgctgagcgggctggcaaggc

SEQ ID NO: 1916 - DNA, 495 bp, Artificial Sequence
  Synthetic Template Oligonucleotide for IgH VJ Locus
gcctccctcgcgccatcagagagtgtcccttatagcttgcctggcccagtacacctggctccccgctatccccagacagcagactcacctgaggagacggtgaccagggtgccctggccccagtgctggaagtatgtcgacagagtgtcccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacagagtgtcccttatagctgagcgggctggcaaggc

SEQ ID NO: 1917 - DNA, 495 bp, Artificial Sequence
  Synthetic Template Oligonucleotide for IgH VJ Locus
gcctccctcgcgccatcagagagtgtctacgcgttcttgcctggcccagtacacctggctccccgctatccccagacagcagactcacctgaggagacggtgaccagggtgccctggccccagtgctggaagtatgtcgacagagtgtctacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccagagtgtctacgcgttctgagcgggctggcaaggc

SEQ ID NO: 1918 - DNA, 495 bp, Artificial Sequence
  Synthetic Template Oligonucleotide for IgH VJ Locus
gcctccctcgcgccatcagagagtgtcctataaggcttgcctggcccagtacacctggctccccgctatccccagacagcagactcacctgaggagacggtgaccagggtgccctggccccagtgctggaagtatgtcgacagagtgtcctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgagagtgtcctataaggctgagcgggctggcaaggc

SEQ ID NO: 1919 - DNA, 495 bp, Artificial Sequence
  Synthetic Template Oligonucleotide for IgH VJ Locus
gcctccctcgcgccatcagagagtgtctcttagtccttgcctggcccagtacacctggctccccgctatccccagacagcagactcacctgaggagacggtgaccagggtgccctggccccagtgctggaagtatgtcgacagagtgtctcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcagagtgtctcttagtcctgagcgggctggcaaggc

SEQ ID NO: 1920 - DNA, 495 bp, Artificial Sequence
  Synthetic Template Oligonucleotide for IgH VJ Locus
gcctccctcgcgccatcagagagtgtctgtctgcacttgcctggcccagtacacctggctccccgctatccccagacagcagactcacctgaggagacggtgaccagggtgccctggccccagtgctggaagtatgtcgacagagtgtctgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccagagtgtctgtctgcactgagcgggctggcaaggc

SEQ ID NO: 1921 - DNA, 495 bp, Artificial Sequence
  Synthetic Template Oligonucleotide for IgH VJ Locus
gcctccctcgcgccatcagagagtgtcgccattaacttgcctggcccagtacacctggctccccgctatccccagacagcagactcacctgaggagacggtgaccagggtgccctggccccagtgctggaagtatgtcgacagagtgtcgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcagagtgtcgccattaactgagcgggctggcaaggc

SEQ ID NO: 1922 - DNA, 495 bp, Artificial Sequence
  Synthetic Template Oligonucleotide for IgH VJ Locus
gcctccctcgcgccatcagagagtgtcgactaagacttgcctggcccagtacacctggctccccgctatccccagacagcagactcacctgaggagacggtgaccagggtgccctggccccagtgctggaagtatgtcgacagagtgtcgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgagagtgtcgactaagactgagcgggctggcaaggc

SEQ ID NO: 1923 - DNA, 495 bp, Artificial Sequence
  Synthetic Template Oligonucleotide for IgH VJ Locus
gcctccctcgcgccatcagagagtgtcaggttgctcttgcctggcccagtacacctggctccccgctatccccagacagcagactcacctgaggagacggtgaccagggtgccctggccccagtgctggaagtatgtcgacagagtgtcaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgagagtgtcaggttgctctgagcgggctggcaaggc

SEQ ID NO: 1924 - DNA, 495 bp, Artificial Sequence
  Synthetic Template Oligonucleotide for IgH VJ Locus
gcctccctcgcgccatcagagagtgtcctcgagaacttgcctggcccagtacacctggctccccgctatccccagacagcagactcacctgaggagacggtgaccagggtgccctggccccagtgctggaagtatgtcgacagagtgtcctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccagagtgtcctcgagaactgagcgggctggcaaggc

SEQ ID NO: 1925 - DNA, 495 bp, Artificial Sequence
  Synthetic Template Oligonucleotide for IgH VJ Locus
gcctccctcgcgccatcagagagtgtcttaatggccttgcctggcccagtacacctggctccccgctatccccagacagcagactcacctgaggagacggtgaccagggtgccctggccccagtgctggaagtatgtcgacagagtgtcttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccagagtgtcttaatggcctgagcgggctggcaaggc

SEQ ID NO: 1926 - DNA, 495 bp, Artificial Sequence
  Synthetic Template Oligonucleotide for IgH VJ Locus
gcctccctcgcgccatcagagagtgtctgcagacacttgcctggcccagtacacctggctccccgctatccccagacagcagactcacctgaggagacggtgaccagggtgccctggccccagtgctggaagtatgtcgacagagtgtctgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaaagagtgtctgcagacactgagcgggctggcaaggc

SEQ ID NO: 1927 - DNA, 495 bp, Artificial Sequence
  Synthetic Template Oligonucleotide for IgH VJ Locus
gcctccctcgcgccatcagagagtgtctcactgagcttgcctggcccagtacacctggctccccgctatccccagacagcagactcacctgaggagacggtgaccagggtgccctggccccagtgctggaagtatgtcgacagagtgtctcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtagagtgtctcactgagctgagcgggctggcaaggc

SEQ ID NO: 1928 - DNA, 495 bp, Artificial Sequence
  Synthetic Template Oligonucleotide for IgH VJ Locus
gcctccctcgcgccatcagagagtgtcgagtacgtcttgcctggcccagtacacctggctccccgctatccccagacagcagactcacctgaggagacggtgaccagggtgccctggccccagtgctggaagtatgtcgacagagtgtcgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacagagtgtcgagtacgtctgagcgggctggcaaggc

SEQ ID NO: 1929 - DNA, 495 bp, Artificial Sequence
  Synthetic Template Oligonucleotide for IgH VJ Locus
gcctccctcgcgccatcagagagtgtcatacgccacttgcctggcccagtacacctggctccccgctatccccagacagcagactcacctgaggagacggtgaccagggtgccctggccccagtgctggaagtatgtcgacagagtgtcatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacagagtgtcatacgccactgagcgggctggcaaggc

SEQ ID NO: 1930 - DNA, 495 bp, Artificial Sequence
  Synthetic Template Oligonucleotide for IgH VJ Locus
gcctccctcgcgccatcagagagtgtctcgcatcacttgcctggcccagtacacctggctccccgctatccccagacagcagactcacctgaggagacggtgaccagggtgccctggccccagtgctggaagtatgtcgacagagtgtctcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacagagtgtctcgcatcactgagcgggctggcaaggc

SEQ ID NO: 1931 - DNA, 495 bp, Artificial Sequence
  Synthetic Template Oligonucleotide for IgH VJ Locus
gcctccctcgcgccatcagagagtgtccgcttaatcttgcctggcccagtacacctggctccccgctatccccagacagcagactcacctgaggagacggtgaccagggtgccctggccccagtgctggaagtatgtcgacagagtgtccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacagagtgtccgcttaatctgagcgggctggcaaggc

SEQ ID NO: 1932 - DNA, 495 bp, Artificial Sequence
  Synthetic Template Oligonucleotide for IgH VJ Locus
gcctccctcgcgccatcagagagtgtctggttatccttgcctggcccagtacacctggctccccgctatccccagacagcagactcacctgaggagacggtgaccagggtgccctggccccagtgctggaagtatgtcgacagagtgtctggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtagagtgtctggttatcctgagcgggctggcaaggc

SEQ ID NO: 1933 - DNA, 495 bp, Artificial Sequence
  Synthetic Template Oligonucleotide for IgH VJ Locus
gcctccctcgcgccatcagagagtgtcggattgctcttgcctggcccagtacacctggctccccgctatccccagacagcagactcacctgaggagacggtgaccagggtgccctggccccagtgctggaagtatgtcgacagagtgtcggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacagagtgtcggattgctctgagcgggctggcaaggc

SEQ ID NO: 1934 - DNA, 495 bp, Artificial Sequence
  Synthetic Template Oligonucleotide for IgH VJ Locus
gcctccctcgcgccatcagagagtgtcctcagtgacttgcctggcccagtacacctggctccccgctatccccagacagcagactcacctgaggagacggtgaccagggtgccctggccccagtgctggaagtatgtcgacagagtgtcctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtagagtgtcctcagtgactgagcgggctggcaaggc

SEQ ID NO: 1935 - DNA, 495 bp, Artificial Sequence
  Synthetic Template Oligonucleotide for IgH VJ Locus
gcctccctcgcgccatcagagagtgtcacgtactccttgcctggcccagtacacctggctccccgctatccccagacagcagactcacctgaggagacggtgaccagggtgccctggccccagtgctggaagtatgtcgacagagtgtcacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacagagtgtcacgtactcctgagcgggctggcaaggc

SEQ ID NO: 1936 - DNA, 495 bp, Artificial Sequence
  Synthetic Template Oligonucleotide for IgH VJ Locus
gcctccctcgcgccatcagagagtgtctgatgcgacttgcctggcccagtacacctggctccccgctatccccagacagcagactcacctgaggagacggtgaccagggtgccctggccccagtgctggaagtatgtcgacagagtgtctgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccagagtgtctgatgcgactgagcgggctggcaaggc

SEQ ID NO: 1937 - DNA, 495 bp, Artificial Sequence
  Synthetic Template Oligonucleotide for IgH VJ Locus
gcctccctcgcgccatcagagagtgtcattaagcgcttgcctggcccagtacacctggctccccgctatccccagacagcagactcacctgaggagacggtgaccagggtgccctggccccagtgctggaagtatgtcgacagagtgtcattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccagagtgtcattaagcgctgagcgggctggcaaggc

SEQ ID NO: 1938 - DNA, 495 bp, Artificial Sequence
  Synthetic Template Oligonucleotide for IgH VJ Locus
gcctccctcgcgccatcagagagtgtcagcaatcccttgcctggcccagtacacctggctccccgctatccccagacagcagactcacctgaggagacggtgaccagggtgccctggccccagtgctggaagtatgtcgacagagtgtcagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccagagtgtcagcaatccctgagcgggctggcaaggc

SEQ ID NO: 1939 - DNA, 495 bp, Artificial Sequence
  Synthetic Template Oligonucleotide for IgH VJ Locus
gcctccctcgcgccatcagagagtgtcgcttagtacttgcctggcccagtacacctggctccccgctatccccagacagcagactcacctgaggagacggtgaccagggtgccctggccccagtgctggaagtatgtcgacagagtgtcgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgaagagtgtcgcttagtactgagcgggctggcaaggc

SEQ ID NO: 1940 - DNA, 495 bp, Artificial Sequence
  Synthetic Template Oligonucleotide for IgH VJ Locus
gcctccctcgcgccatcagagagtgtctgaccttgcttgcctggcccagtacacctggctccccgctatccccagacagcagactcacctgaggagacggtgaccagggtgccctggccccagtgctggaagtatgtcgacagagtgtctgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccagagtgtctgaccttgctgagcgggctggcaaggc

SEQ ID NO: 1941 - DNA, 495 bp, Artificial Sequence
  Synthetic Template Oligonucleotide for IgH VJ Locus
gcctccctcgcgccatcagagagtgtccaaggtcacttgcctggcccagtacacctggctccccgctatccccagacagcagactcacctgaggagacggtgaccagggtgccctggccccagtgctggaagtatgtcgacagagtgtccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccagagtgtccaaggtcactgagcgggctggcaaggc

SEQ ID NO: 1942 - DNA, 495 bp, Artificial Sequence
  Synthetic Template Oligonucleotide for IgH VJ Locus
gcctccctcgcgccatcagagagtgtccactgtaccttgcctggcccagtacacctggctccccgctatccccagacagcagactcacctgaggagacggtgaccagggtgccctggccccagtgctggaagtatgtcgacagagtgtccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcagagtgtccactgtacctgagcgggctggcaaggc

SEQ ID NO: 1943 - DNA, 495 bp, Artificial Sequence
  Synthetic Template Oligonucleotide for IgH VJ Locus
gcctccctcgcgccatcagagagtgtcgatgatcccttgcctggcccagtacacctggctccccgctatccccagacagcagactcacctgaggagacggtgaccagggtgccctggccccagtgctggaagtatgtcgacagagtgtcgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggagagtgtcgatgatccctgagcgggctggcaaggc

SEQ ID NO: 1944 - DNA, 495 bp, Artificial Sequence
  Synthetic Template Oligonucleotide for IgH VJ Locus
gcctccctcgcgccatcagagagtgtccgccaatacttgcctggcccagtacacctggctccccgctatccccagacagcagactcacctgaggagacggtgaccagggtgccctggccccagtgctggaagtatgtcgacagagtgtccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggagagtgtccgccaatactgagcgggctggcaaggc

SEQ ID NO: 1945 - DNA, 495 bp, Artificial Sequence
  Synthetic Template Oligonucleotide for IgH VJ Locus
gcctccctcgcgccatcagagagtgtctcaagcctcttgcctggcccagtacacctggctccccgctatccccagacagcagactcacctgaggagacggtgaccagggtgccctggccccagtgctggaagtatgtcgacagagtgtctcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacaagagtgtctcaagcctctgagcgggctggcaaggc

SEQ ID NO: 1946 - DNA, 495 bp, Artificial Sequence
  Synthetic Template Oligonucleotide for IgH VJ Locus
gcctccctcgcgccatcagagagtgtcacgtgtgtcttgcctggcccagtacacctggctccccgctatccccagacagcagactcacctgaggagacggtgaccagggtgccctggccccagtgctggaagtatgtcgacagagtgtcacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagagagtgtcacgtgtgtctgagcgggctggcaaggc

SEQ ID NO: 1947 - DNA, 495 bp, Artificial Sequence
  Synthetic Template Oligonucleotide for IgH VJ Locus
gcctccctcgcgccatcagagagtgtctccgtctacttgcctggcccagtacacctggctccccgctatccccagacagcagactcacctgaggagacggtgaccagggtgccctggccccagtgctggaagtatgtcgacagagtgtctccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagagagtgtctccgtctactgagcgggctggcaaggc

SEQ ID NO: 1948 - DNA, 495 bp, Artificial Sequence
  Synthetic Template Oligonucleotide for IgH VJ Locus
gcctccctcgcgccatcagagagtgtcaagagctgcttgcctggcccagtacacctggctccccgctatccccagacagcagactcacctgaggagacggtgaccagggtgccctggccccagtgctggaagtatgtcgacagagtgtcaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgagagtgtcaagagctgctgagcgggctggcaaggc

SEQ ID NO: 1949 - DNA, 495 bp, Artificial Sequence
  Synthetic Template Oligonucleotide for IgH VJ Locus
gcctccctcgcgccatcagagagtgtctatcgctccttgcctggcccagtacacctggctccccgctatccccagacagcagactcacctgaggagacggtgaccagggtgccctggccccagtgctggaagtatgtcgacagagtgtctatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagagagtgtctatcgctcctgagcgggctggcaaggc

SEQ ID NO: 1950 - DNA, 495 bp, Artificial Sequence
  Synthetic Template Oligonucleotide for IgH VJ Locus
gcctccctcgcgccatcagagagtgtctcagatgccttgcctggcccagtacacctggctccccgctatccccagacagcagactcacctgaggagacggtgaccagggtgccctggccccagtgctggaagtatgtcgacagagtgtctcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccagagtgtctcagatgcctgagcgggctggcaaggc

SEQ ID NO: 1951 - DNA, 495 bp, Artificial Sequence
  Synthetic Template Oligonucleotide for IgH VJ Locus
gcctccctcgcgccatcagagagtgtcgtgtagcacttgcctggcccagtacacctggctccccgctatccccagacagcagactcacctgaggagacggtgaccagggtgccctggccccagtgctggaagtatgtcgacagagtgtcgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgagagtgtcgtgtagcactgagcgggctggcaaggc

SEQ ID NO: 1952 - DNA, 495 bp, Artificial Sequence
  Synthetic Template Oligonucleotide for IgH VJ Locus
gcctccctcgcgccatcagagagtgtctggcagttcttgcctggcccagtacacctggctccccgctatccccagacagcagactcacctgaggagacggtgaccagggtgccctggccccagtgctggaagtatgtcgacagagtgtctggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgagagtgtctggcagttctgagcgggctggcaaggc

SEQ ID NO: 1953 - DNA, 495 bp, Artificial Sequence
  Synthetic Template Oligonucleotide for IgH VJ Locus
gcctccctcgcgccatcagagagtgtccagtccaacttgcctggcccagtacacctggctccccgctatccccagacagcagactcacctgaggagacggtgaccagggtgccctggccccagtgctggaagtatgtcgacagagtgtccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacagagtgtccagtccaactgagcgggctggcaaggc

SEQ ID NO: 1954 - DNA, 495 bp, Artificial Sequence
  Synthetic Template Oligonucleotide for IgH VJ Locus
gcctccctcgcgccatcagagagtgtcgtgtctaccttgcctggcccagtacacctggctccccgctatccccagacagcagactcacctgaggagacggtgaccagggtgccctggccccagtgctggaagtatgtcgacagagtgtcgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggagagtgtcgtgtctacctgagcgggctggcaaggc

SEQ ID NO: 1955 - DNA, 495 bp, Artificial Sequence
  Synthetic Template Oligonucleotide for IgH VJ Locus
gcctccctcgcgccatcagagagtgtcgtacagtgcttgcctggcccagtacacctggctccccgctatccccagacagcagactcacctgaggagacggtgaccagggtgccctggccccagtgctggaagtatgtcgacagagtgtcgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagagagtgtcgtacagtgctgagcgggctggcaaggc

SEQ ID NO: 1956 - DNA, 495 bp, Artificial Sequence
  Synthetic Template Oligonucleotide for IgH VJ Locus
gcctccctcgcgccatcagagagtgtcggatcatccttgcctggcccagtacacctggctccccgctatccccagacagcagactcacctgaggagacggtgaccagggtgccctggccccagtgctggaagtatgtcgacagagtgtcggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagagagtgtcggatcatcctgagcgggctggcaaggc

SEQ ID NO: 1957 - DNA, 495 bp, Artificial Sequence
  Synthetic Template Oligonucleotide for IgH VJ Locus
gcctccctcgcgccatcagagagtgtctattggcgcttgcctggcccagtacacctggctccccgctatccccagacagcagactcacctgaggagacggtgaccagggtgccctggccccagtgctggaagtatgtcgacagagtgtctattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcaagagtgtctattggcgctgagcgggctggcaaggc

SEQ ID NO: 1958 - DNA, 495 bp, Artificial Sequence
  Synthetic Template Oligonucleotide for IgH VJ Locus
gcctccctcgcgccatcagagagtgtcaggcttgacttgcctggcccagtacacctggctccccgctatccccagacagcagactcacctgaggagacggtgaccagggtgccctggccccagtgctggaagtatgtcgacagagtgtcaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacagagtgtcaggcttgactgagcgggctggcaaggc

SEQ ID NO: 1959 - DNA, 495 bp, Artificial Sequence
  Synthetic Template Oligonucleotide for IgH VJ Locus
gcctccctcgcgccatcagagagtgtcacacacgtcttgcctggcccagtacacctggctccccgctatccccagacagcagactcacctgaggagacggtgaccagggtgccctggccccagtgctggaagtatgtcgacagagtgtcacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatagagtgtcacacacgtctgagcgggctggcaaggc

SEQ ID NO: 1960 - DNA, 495 bp, Artificial Sequence
  Synthetic Template Oligonucleotide for IgH VJ Locus
gcctccctcgcgccatcagagagtgtctagacggacttgcctggcccagtacacctggctccccgctatccccagacagcagactcacctgaggagacggtgaccagggtgccctggccccagtgctggaagtatgtcgacagagtgtctagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaagagtgtctagacggactgagcgggctggcaaggc

SEQ ID NO: 1961 - DNA, 495 bp, Artificial Sequence
  Synthetic Template Oligonucleotide for IgH VJ Locus
gcctccctcgcgccatcagagagtgtcgagcgatacttgcctggcccagtacacctggctccccgctatccccagacagcagactcacctgaggagacggtgaccagggtgccctggccccagtgctggaagtatgtcgacagagtgtcgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttagagtgtcgagcgatactgagcgggctggcaaggc

SEQ ID NO: 1962 - DNA, 495 bp, Artificial Sequence
  Synthetic Template Oligonucleotide for IgH VJ Locus
gcctccctcgcgccatcagagagtgtcgcatctgacttgcctggcccagtacacctggctccccgctatccccagacagcagactcacctgaggagacggtgaccagggtgccctggccccagtgctggaagtatgtcgacagagtgtcgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacaagagtgtcgcatctgactgagcgggctggcaaggc

SEQ ID NO: 1963 - DNA, 495 bp, Artificial Sequence
  Synthetic Template Oligonucleotide for IgH VJ Locus
gcctccctcgcgccatcagagagtgtctgctacaccttgcctggcccagtacacctggctccccgctatccccagacagcagactcacctgaggagacggtgaccagggtgccctggccccagtgctggaagtatgtcgacagagtgtctgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgagagtgtctgctacacctgagcgggctggcaaggc

SEQ ID NO: 1964 - DNA, 495 bp, Artificial Sequence
  Synthetic Template Oligonucleotide for IgH VJ Locus
gcctccctcgcgccatcagagagtgtcaactgccacttgcctggcccagtacacctggctccccgctatccccagacagcagactcacctgaggagacggtgaccagggtgccctggccccagtgctggaagtatgtcgacagagtgtcaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttagagtgtcaactgccactgagcgggctggcaaggc

SEQ ID NO: 1965 - DNA, 495 bp, Artificial Sequence
  Synthetic Template Oligonucleotide for IgH VJ Locus
gcctccctcgcgccatcagagagtgtcttggactgcttgcctggcccagtacacctggctccccgctatccccagacagcagactcacctgaggagacggtgaccagggtgccctggccccagtgctggaagtatgtcgacagagtgtcttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggagagtgtcttggactgctgagcgggctggcaaggc

SEQ ID NO: 1966 - DNA, 495 bp, Artificial Sequence
  Synthetic Template Oligonucleotide for IgH VJ Locus
gcctccctcgcgccatcagagagtgtctcggtactcttgcctggcccagtacacctggctccccgctatccccagacagcagactcacctgaggagacggtgaccagggtgccctggccccagtgctggaagtatgtcgacagagtgtctcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgagagtgtctcggtactctgagcgggctggcaaggc

SEQ ID NO: 1967 - DNA, 495 bp, Artificial Sequence
  Synthetic Template Oligonucleotide for IgH VJ Locus
gcctccctcgcgccatcagagagtgtcccatggatcttgcctggcccagtacacctggctccccgctatccccagacagcagactcacctgaggagacggtgaccagggtgccctggccccagtgctggaagtatgtcgacagagtgtcccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacagagtgtcccatggatctgagcgggctggcaaggc

SEQ ID NO: 1968 - DNA, 495 bp, Artificial Sequence
  Synthetic Template Oligonucleotide for IgH VJ Locus
gcctccctcgcgccatcagagagtgtcacgaagatcttgcctggcccagtacacctggctccccgctatccccagacagcagactcacctgaggagacggtgaccagggtgccctggccccagtgctggaagtatgtcgacagagtgtcacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaaagagtgtcacgaagatctgagcgggctggcaaggc

SEQ ID NO: 1969 - DNA, 495 bp, Artificial Sequence
  Synthetic Template Oligonucleotide for IgH VJ Locus
gcctccctcgcgccatcagagagtgtcactgtggacttgcctggcccagtacacctggctccccgctatccccagacagcagactcacctgaggagacggtgaccagggtgccctggccccagtgctggaagtatgtcgacagagtgtcactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttagagtgtcactgtggactgagcgggctggcaaggc

SEQ ID NO: 1970 - DNA, 495 bp, Artificial Sequence
  Synthetic Template Oligonucleotide for IgH VJ Locus
gcctccctcgcgccatcagagagtgtcggtgtcatcttgcctggcccagtacacctggctccccgctatccccagacagcagactcacctgaggagacggtgaccagggtgccctggccccagtgctggaagtatgtcgacagagtgtcggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctagagtgtcggtgtcatctgagcgggctggcaaggc

SEQ ID NO: 1971 - DNA, 495 bp, Artificial Sequence
  Synthetic Template Oligonucleotide for IgH VJ Locus
gcctccctcgcgccatcagagagtgtctcgtgaagcttgcctggcccagtacacctggctccccgctatccccagacagcagactcacctgaggagacggtgaccagggtgccctggccccagtgctggaagtatgtcgacagagtgtctcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggagagtgtctcgtgaagctgagcgggctggcaaggc

SEQ ID NO: 1972 - DNA, 495 bp, Artificial Sequence
  Synthetic Template Oligonucleotide for IgH VJ Locus
gcctccctcgcgccatcagagagtgtccactagctcttgcctggcccagtacacctggctccccgctatccccagacagcagactcacctgaggagacggtgaccagggtgccctggccccagtgctggaagtatgtcgacagagtgtccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaaagagtgtccactagctctgagcgggctggcaaggc

SEQ ID NO: 1973 - DNA, 495 bp, Artificial Sequence
  Synthetic Template Oligonucleotide for IgH VJ Locus
gcctccctcgcgccatcagagagtgtcggtcaactcttgcctggcccagtacacctggctccccgctatccccagacagcagactcacctgaggagacggtgaccagggtgccctggccccagtgctggaagtatgtcgacagagtgtcggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggaagagtgtcggtcaactctgagcgggctggcaaggc

SEQ ID NO: 1974 - DNA, 495 bp, Artificial Sequence
  Synthetic Template Oligonucleotide for IgH VJ Locus
gcctccctcgcgccatcagagagtgtctacgtacgcttgcctggcccagtacacctggctccccgctatccccagacagcagactcacctgaggagacggtgaccagggtgccctggccccagtgctggaagtatgtcgacagagtgtctacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcagagtgtctacgtacgctgagcgggctggcaaggc

SEQ ID NO: 1975 - DNA, 495 bp, Artificial Sequence
  Synthetic Template Oligonucleotide for IgH VJ Locus
gcctccctcgcgccatcagagagtgtcatgacacccttgcctggcccagtacacctggctccccgctatccccagacagcagactcacctgaggagacggtgaccagggtgccctggccccagtgctggaagtatgtcgacagagtgtcatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggagagtgtcatgacaccctgagcgggctggcaaggc

SEQ ID NO: 1976 - DNA, 495 bp, Artificial Sequence
  Synthetic Template Oligonucleotide for IgH VJ Locus
gcctccctcgcgccatcagagagtgtccttcacgacttgcctggcccagtacacctggctccccgctatccccagacagcagactcacctgaggagacggtgaccagggtgccctggccccagtgctggaagtatgtcgacagagtgtccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacagagtgtccttcacgactgagcgggctggcaaggc

SEQ ID NO: 1977 - DNA, 495 bp, Artificial Sequence
  Synthetic Template Oligonucleotide for IgH VJ Locus
gcctccctcgcgccatcagagagtgtcagaatcagcttgcctggcccagtacacctggctccccgctatccccagacagcagactcacctgaggagacggtgaccagggtgccctggccccagtgctggaagtatgtcgacagagtgtcagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccagagtgtcagaatcagctgagcgggctggcaaggc

SEQ ID NO: 1978 - DNA, 495 bp, Artificial Sequence
  Synthetic Template Oligonucleotide for IgH VJ Locus
gcctccctcgcgccatcagagagtgtcagttatgccttgcctggcccagtacacctggctccccgctatccccagacagcagactcacctgaggagacggtgaccagggtgccctggccccagtgctggaagtatgtcgacagagtgtcagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataaagagtgtcagttatgcctgagcgggctggcaaggc

SEQ ID NO: 1979 - DNA, 495 bp, Artificial Sequence
  Synthetic Template Oligonucleotide for IgH VJ Locus
gcctccctcgcgccatcagagagtgtcaggtctcacttgcctggcccagtacacctggctccccgctatccccagacagcagactcacctgaggagacggtgaccagggtgccctggccccagtgctggaagtatgtcgacagagtgtcaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccagagtgtcaggtctcactgagcgggctggcaaggc

SEQ ID NO: 1980 - DNA, 495 bp, Artificial Sequence
  Synthetic Template Oligonucleotide for IgH VJ Locus
gcctccctcgcgccatcagagagtgtcgtcatagtcttgcctggcccagtacacctggctccccgctatccccagacagcagactcacctgaggagacggtgaccagggtgccctggccccagtgctggaagtatgtcgacagagtgtcgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtagagtgtcgtcatagtctgagcgggctggcaaggc

SEQ ID NO: 1981 - DNA, 495 bp, Artificial Sequence
  Synthetic Template Oligonucleotide for IgH VJ Locus
gcctccctcgcgccatcagagagtgtcgtgacttgcttgcctggcccagtacacctggctccccgctatccccagacagcagactcacctgaggagacggtgaccagggtgccctggccccagtgctggaagtatgtcgacagagtgtcgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgagagtgtcgtgacttgctgagcgggctggcaaggc

SEQ ID NO: 1982 - DNA, 495 bp, Artificial Sequence
  Synthetic Template Oligonucleotide for IgH VJ Locus
gcctccctcgcgccatcagagagtgtcgattgcagcttgcctggcccagtacacctggctccccgctatccccagacagcagactcacctgaggagacggtgaccagggtgccctggccccagtgctggaagtatgtcgacagagtgtcgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccagagtgtcgattgcagctgagcgggctggcaaggc

SEQ ID NO: 1983 - DNA, 495 bp, Artificial Sequence
  Synthetic Template Oligonucleotide for IgH VJ Locus
gcctccctcgcgccatcagagagtgtcactatgaccttgcctggcccagtacacctggctccccgctatccccagacagcagactcacctgaggagacggtgaccagggtgccctggccccagtgctggaagtatgtcgacagagtgtcactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacagagtgtcactatgacctgagcgggctggcaaggc

SEQ ID NO: 1984 - DNA, 495 bp, Artificial Sequence
  Synthetic Template Oligonucleotide for IgH VJ Locus
gcctccctcgcgccatcagagagtgtcatggtcaacttgcctggcccagtacacctggctccccgctatccccagacagcagactcacctgaggagacggtgaccagggtgccctggccccagtgctggaagtatgtcgacagagtgtcatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacagagtgtcatggtcaactgagcgggctggcaaggc

SEQ ID NO: 1985 - DNA, 495 bp, Artificial Sequence
  Synthetic Template Oligonucleotide for IgH VJ Locus
gcctccctcgcgccatcagagagtgtcgatggcttcttgcctggcccagtacacctggctccccgctatccccagacagcagactcacctgaggagacggtgaccagggtgccctggccccagtgctggaagtatgtcgacagagtgtcgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacagagtgtcgatggcttctgagcgggctggcaaggc

SEQ ID NO: 1986 - DNA, 495 bp, Artificial Sequence
  Synthetic Template Oligonucleotide for IgH VJ Locus
gcctccctcgcgccatcagagagtgtcagcatatgcttgcctggcccagtacacctggctccccgctatccccagacagcagactcacctgaggagacggtgaccagggtgccctggccccagtgctggaagtatgtcgacagagtgtcagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacagagtgtcagcatatgctgagcgggctggcaaggc

SEQ ID NO: 1987 - DNA, 495 bp, Artificial Sequence
  Synthetic Template Oligonucleotide for IgH VJ Locus
gcctccctcgcgccatcagagagtgtccatatgctcttgcctggcccagtacacctggctccccgctatccccagacagcagactcacctgaggagacggtgaccagggtgccctggccccagtgctggaagtatgtcgacagagtgtccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgagagtgtccatatgctctgagcgggctggcaaggc

SEQ ID NO: 1988 - DNA, 495 bp, Artificial Sequence
  Synthetic Template Oligonucleotide for IgH VJ Locus
gcctccctcgcgccatcagagagtgtctcgtcgatcttgcctggcccagtacacctggctccccgctatccccagacagcagactcacctgaggagacggtgaccagggtgccctggccccagtgctggaagtatgtcgacagagtgtctcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccagagtgtctcgtcgatctgagcgggctggcaaggc

SEQ ID NO: 1989 - DNA, 495 bp, Artificial Sequence
  Synthetic Template Oligonucleotide for IgH VJ Locus
gcctccctcgcgccatcagagagtgtccagtctgtcttgcctggcccagtacacctggctccccgctatccccagacagcagactcacctgaggagacggtgaccagggtgccctggccccagtgctggaagtatgtcgacagagtgtccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcagagtgtccagtctgtctgagcgggctggcaaggc

SEQ ID NO: 1990 - DNA, 495 bp, Artificial Sequence
  Synthetic Template Oligonucleotide for IgH VJ Locus
gcctccctcgcgccatcagagagtgtcaacgcgtacttgcctggcccagtacacctggctccccgctatccccagacagcagactcacctgaggagacggtgaccagggtgccctggccccagtgctggaagtatgtcgacagagtgtcaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgagagtgtcaacgcgtactgagcgggctggcaaggc

SEQ ID NO: 1991 - DNA, 495 bp, Artificial Sequence
  Synthetic Template Oligonucleotide for IgH VJ Locus
gcctccctcgcgccatcagagagtgtcgtagttcgcttgcctggcccagtacacctggctccccgctatccccagacagcagactcacctgaggagacggtgaccagggtgccctggccccagtgctggaagtatgtcgacagagtgtcgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcagagtgtcgtagttcgctgagcgggctggcaaggc

SEQ ID NO: 1992 - DNA, 495 bp, Artificial Sequence
  Synthetic Template Oligonucleotide for IgH VJ Locus
gcctccctcgcgccatcagagagtgtccgaactaccttgcctggcccagtacacctggctccccgctatccccagacagcagactcacctgaggagacggtgaccagggtgccctggccccagtgctggaagtatgtcgacagagtgtccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacagagtgtccgaactacctgagcgggctggcaaggc

SEQ ID NO: 1993 - DNA, 495 bp, Artificial Sequence
  Synthetic Template Oligonucleotide for IgH VJ Locus
gcctccctcgcgccatcagagagtgtcttaacgtccttgcctggcccagtacacctggctccccgctatccccagacagcagactcacctgaggagacggtgaccagggtgccctggccccagtgctggaagtatgtcgacagagtgtcttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccagagtgtcttaacgtcctgagcgggctggcaaggc

SEQ ID NO: 1994 - DNA, 495 bp, Artificial Sequence
  Synthetic Template Oligonucleotide for IgH VJ Locus
gcctccctcgcgccatcagagagtgtcagcaacctcttgcctggcccagtacacctggctccccgctatccccagacagcagactcacctgaggagacggtgaccagggtgccctggccccagtgctggaagtatgtcgacagagtgtcagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacagagtgtcagcaacctctgagcgggctggcaaggc

SEQ ID NO: 1995 - DNA, 495 bp, Artificial Sequence
  Synthetic Template Oligonucleotide for IgH VJ Locus
gcctccctcgcgccatcagagagtgtcttctcgagcttgcctggcccagtacacctggctccccgctatccccagacagcagactcacctgaggagacggtgaccagggtgccctggccccagtgctggaagtatgtcgacagagtgtcttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttagagtgtcttctcgagctgagcgggctggcaaggc

SEQ ID NO: 1996 - DNA, 495 bp, Artificial Sequence
  Synthetic Template Oligonucleotide for IgH VJ Locus
gcctccctcgcgccatcagagagtgtcactctacgcttgcctggcccagtacacctggctccccgctatccccagacagcagactcacctgaggagacggtgaccagggtgccctggccccagtgctggaagtatgtcgacagagtgtcactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacagagtgtcactctacgctgagcgggctggcaaggc

SEQ ID NO: 1997 - DNA, 495 bp, Artificial Sequence
  Synthetic Template Oligonucleotide for IgH VJ Locus
gcctccctcgcgccatcagagagtgtctaccggaacttgcctggcccagtacacctggctccccgctatccccagacagcagactcacctgaggagacggtgaccagggtgccctggccccagtgctggaagtatgtcgacagagtgtctaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccagagtgtctaccggaactgagcgggctggcaaggc

SEQ ID NO: 1998 - DNA, 495 bp, Artificial Sequence
  Synthetic Template Oligonucleotide for IgH VJ Locus
gcctccctcgcgccatcagagagtgtccgaattgccttgcctggcccagtacacctggctccccgctatccccagacagcagactcacctgaggagacggtgaccagggtgccctggccccagtgctggaagtatgtcgacagagtgtccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacagagtgtccgaattgcctgagcgggctggcaaggc

SEQ ID NO: 1999 - DNA, 495 bp, Artificial Sequence
  Synthetic Template Oligonucleotide for IgH VJ Locus
gcctccctcgcgccatcagagagtgtcttcgctcacttgcctggcccagtacacctggctccccgctatccccagacagcagactcacctgaggagacggtgaccagggtgccctggccccagtgctggaagtatgtcgacagagtgtcttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacaagagtgtcttcgctcactgagcgggctggcaaggc

SEQ ID NO: 2000 - DNA, 495 bp, Artificial Sequence
  Synthetic Template Oligonucleotide for IgH VJ Locus
gcctccctcgcgccatcagagagtgtcgacgttaacttgcctggcccagtacacctggctccccgctatccccagacagcagactcacctgaggagacggtgaccagggtgccctggccccagtgctggaagtatgtcgacagagtgtcgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgagagtgtcgacgttaactgagcgggctggcaaggc

SEQ ID NO: 2001 - DNA, 495 bp, Artificial Sequence
  Synthetic Template Oligonucleotide for IgH VJ Locus
gcctccctcgcgccatcagagagtgtccgtagagtcttgcctggcccagtacacctggctccccgctatccccagacagcagactcacctgaggagacggtgaccagggtgccctggccccagtgctggaagtatgtcgacagagtgtccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcagagtgtccgtagagtctgagcgggctggcaaggc

SEQ ID NO: 2002 - DNA, 495 bp, Artificial Sequence
  Synthetic Template Oligonucleotide for IgH VJ Locus
gcctccctcgcgccatcagagagtgtcttccggtacttgcctggcccagtacacctggctccccgctatccccagacagcagactcacctgaggagacggtgaccagggtgccctggccccagtgctggaagtatgtcgacagagtgtcttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcagagtgtcttccggtactgagcgggctggcaaggc

SEQ ID NO: 2003 - DNA, 495 bp, Artificial Sequence
  Synthetic Template Oligonucleotide for IgH VJ Locus
gcctccctcgcgccatcagagagtgtcgcaattcgcttgcctggcccagtacacctggctccccgctatccccagacagcagactcacctgaggagacggtgaccagggtgccctggccccagtgctggaagtatgtcgacagagtgtcgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacagagtgtcgcaattcgctgagcgggctggcaaggc

SEQ ID NO: 2004 - DNA, 495 bp, Artificial Sequence
  Synthetic Template Oligonucleotide for IgH VJ Locus
gcctccctcgcgccatcagagagtgtctgagcgaacttgcctggcccagtacacctggctccccgctatccccagacagcagactcacctgaggagacggtgaccagggtgccctggccccagtgctggaagtatgtcgacagagtgtctgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcagagtgtctgagcgaactgagcgggctggcaaggc

SEQ ID NO: 2005 - DNA, 495 bp, Artificial Sequence
  Synthetic Template Oligonucleotide for IgH VJ Locus
gcctccctcgcgccatcagagagtgtctactaagccttgcctggcccagtacacctggctccccgctatccccagacagcagactcacctgaggagacggtgaccagggtgccctggccccagtgctggaagtatgtcgacagagtgtctactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccagagtgtctactaagcctgagcgggctggcaaggc

SEQ ID NO: 2006 - DNA, 495 bp, Artificial Sequence
  Synthetic Template Oligonucleotide for IgH VJ Locus
gcctccctcgcgccatcagagagtgtctggcgtatcttgcctggcccagtacacctggctccccgctatccccagacagcagactcacctgaggagacggtgaccagggtgccctggccccagtgctggaagtatgtcgacagagtgtctggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtagagtgtctggcgtatctgagcgggctggcaaggc

SEQ ID NO: 2007 - DNA, 495 bp, Artificial Sequence
  Synthetic Template Oligonucleotide for IgH VJ Locus
gcctccctcgcgccatcagagagtgtcgataaccacttgcctggcccagtacacctggctccccgctatccccagacagcagactcacctgaggagacggtgaccagggtgccctggccccagtgctggaagtatgtcgacagagtgtcgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgagagtgtcgataaccactgagcgggctggcaaggc

SEQ ID NO: 2008 - DNA, 495 bp, Artificial Sequence
  Synthetic Template Oligonucleotide for IgH VJ Locus
gcctccctcgcgccatcagagagtgtcctagtgaacttgcctggcccagtacacctggctccccgctatccccagacagcagactcacctgaggagacggtgaccagggtgccctggccccagtgctggaagtatgtcgacagagtgtcctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagagagtgtcctagtgaactgagcgggctggcaaggc

SEQ ID NO: 2009 - DNA, 495 bp, Artificial Sequence
  Synthetic Template Oligonucleotide for IgH VJ Locus
gcctccctcgcgccatcagagagtgtcacgttcaccttgcctggcccagtacacctggctccccgctatccccagacagcagactcacctgaggagacggtgaccagggtgccctggccccagtgctggaagtatgtcgacagagtgtcacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtagagtgtcacgttcacctgagcgggctggcaaggc

SEQ ID NO: 2010 - DNA, 448 bp, Artificial Sequence
  Synthetic Template Oligonucleotide for IgH VJ Locus
gcctccctcgcgccatcagagagtgtcattacgctcttgcctggcccagtacacctggctccccgctatccccagacagcagactcacctgaggagacggtgaccagggtgccctggccccagtgctggaagtatgtcgacagagtgtcattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcaagagtgtcattacgctctgagcgggctggcaaggc

SEQ ID NO: 2011 - DNA, 495 bp, Artificial Sequence
  Synthetic Template Oligonucleotide for IgH VJ Locus
gcctccctcgcgccatcagagagtgtccattgagtcttgcctggcccagtacacctggctccccgctatccccagacagcagactcacctgaggagacggtgaccagggtgccctggccccagtgctggaagtatgtcgacagagtgtccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccagagtgtccattgagtctgagcgggctggcaaggc

SEQ ID NO: 2012 - DNA, 495 bp, Artificial Sequence
  Synthetic Template Oligonucleotide for IgH VJ Locus
gcctccctcgcgccatcaggttccgaacttggttatggcctggtgcctggacagagaagactgggagggggctgcagtgggactcacctgaggagacagtgaccagggtgccacggccccagagatcgaagtaccgtcgacgttccgaacttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgttccgaacttggttactgagcgggctggcaaggc

SEQ ID NO: 2013 - DNA, 495 bp, Artificial Sequence
  Synthetic Template Oligonucleotide for IgH VJ Locus
gcctccctcgcgccatcaggttccgaaacctcttgtggcctggtgcctggacagagaagactgggagggggctgcagtgggactcacctgaggagacagtgaccagggtgccacggccccagagatcgaagtaccgtcgacgttccgaaacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgttccgaaacctcttgctgagcgggctggcaaggc

SEQ ID NO: 2014 - DNA, 495 bp, Artificial Sequence
  Synthetic Template Oligonucleotide for IgH VJ Locus
gcctccctcgcgccatcaggttccgaactgattcttggcctggtgcctggacagagaagactgggagggggctgcagtgggactcacctgaggagacagtgaccagggtgccacggccccagagatcgaagtaccgtcgacgttccgaactgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgttccgaactgattctctgagcgggctggcaaggc

SEQ ID NO: 2015 - DNA, 495 bp, Artificial Sequence
  Synthetic Template Oligonucleotide for IgH VJ Locus
gcctccctcgcgccatcaggttccgaaagtaccgatggcctggtgcctggacagagaagactgggagggggctgcagtgggactcacctgaggagacagtgaccagggtgccacggccccagagatcgaagtaccgtcgacgttccgaaagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgttccgaaagtaccgactgagcgggctggcaaggc

SEQ ID NO: 2016 - DNA, 495 bp, Artificial Sequence
  Synthetic Template Oligonucleotide for IgH VJ Locus
gcctccctcgcgccatcaggttccgaaatccatggtggcctggtgcctggacagagaagactgggagggggctgcagtgggactcacctgaggagacagtgaccagggtgccacggccccagagatcgaagtaccgtcgacgttccgaaatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgttccgaaatccatggctgagcgggctggcaaggc

SEQ ID NO: 2017 - DNA, 495 bp, Artificial Sequence
  Synthetic Template Oligonucleotide for IgH VJ Locus
gcctccctcgcgccatcaggttccgaagtagcagttggcctggtgcctggacagagaagactgggagggggctgcagtgggactcacctgaggagacagtgaccagggtgccacggccccagagatcgaagtaccgtcgacgttccgaagtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgttccgaagtagcagtctgagcgggctggcaaggc

SEQ ID NO: 2018 - DNA, 495 bp, Artificial Sequence
  Synthetic Template Oligonucleotide for IgH VJ Locus
gcctccctcgcgccatcaggttccgaaatcttcgttggcctggtgcctggacagagaagactgggagggggctgcagtgggactcacctgaggagacagtgaccagggtgccacggccccagagatcgaagtaccgtcgacgttccgaaatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgttccgaaatcttcgtctgagcgggctggcaaggc

SEQ ID NO: 2019 - DNA, 495 bp, Artificial Sequence
  Synthetic Template Oligonucleotide for IgH VJ Locus
gcctccctcgcgccatcaggttccgaatccacagttggcctggtgcctggacagagaagactgggagggggctgcagtgggactcacctgaggagacagtgaccagggtgccacggccccagagatcgaagtaccgtcgacgttccgaatccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgttccgaatccacagtctgagcgggctggcaaggc

SEQ ID NO: 2020 - DNA, 495 bp, Artificial Sequence
  Synthetic Template Oligonucleotide for IgH VJ Locus
gcctccctcgcgccatcaggttccgaaagctagtgtggcctggtgcctggacagagaagactgggagggggctgcagtgggactcacctgaggagacagtgaccagggtgccacggccccagagatcgaagtaccgtcgacgttccgaaagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgttccgaaagctagtgctgagcgggctggcaaggc

SEQ ID NO: 2021 - DNA, 495 bp, Artificial Sequence
  Synthetic Template Oligonucleotide for IgH VJ Locus
gcctccctcgcgccatcaggttccgaataaccaagtggcctggtgcctggacagagaagactgggagggggctgcagtgggactcacctgaggagacagtgaccagggtgccacggccccagagatcgaagtaccgtcgacgttccgaataaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgttccgaataaccaagctgagcgggctggcaaggc

SEQ ID NO: 2022 - DNA, 495 bp, Artificial Sequence
  Synthetic Template Oligonucleotide for IgH VJ Locus
gcctccctcgcgccatcaggttccgaacaagaggttggcctggtgcctggacagagaagactgggagggggctgcagtgggactcacctgaggagacagtgaccagggtgccacggccccagagatcgaagtaccgtcgacgttccgaacaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgttccgaacaagaggtctgagcgggctggcaaggc

SEQ ID NO: 2023 - DNA, 495 bp, Artificial Sequence
  Synthetic Template Oligonucleotide for IgH VJ Locus
gcctccctcgcgccatcaggttccgaaagttgacctggcctggtgcctggacagagaagactgggagggggctgcagtgggactcacctgaggagacagtgaccagggtgccacggccccagagatcgaagtaccgtcgacgttccgaaagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagttccgaaagttgaccctgagcgggctggcaaggc

SEQ ID NO: 2024 - DNA, 495 bp, Artificial Sequence
  Synthetic Template Oligonucleotide for IgH VJ Locus
gcctccctcgcgccatcaggttccgaacagcatattggcctggtgcctggacagagaagactgggagggggctgcagtgggactcacctgaggagacagtgaccagggtgccacggccccagagatcgaagtaccgtcgacgttccgaacagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagttccgaacagcatatctgagcgggctggcaaggc

SEQ ID NO: 2025 - DNA, 495 bp, Artificial Sequence
  Synthetic Template Oligonucleotide for IgH VJ Locus
gcctccctcgcgccatcaggttccgaagcaggatttggcctggtgcctggacagagaagactgggagggggctgcagtgggactcacctgaggagacagtgaccagggtgccacggccccagagatcgaagtaccgtcgacgttccgaagcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagttccgaagcaggattctgagcgggctggcaaggc

SEQ ID NO: 2026 - DNA, 495 bp, Artificial Sequence
  Synthetic Template Oligonucleotide for IgH VJ Locus
gcctccctcgcgccatcaggttccgaagtccattctggcctggtgcctggacagagaagactgggagggggctgcagtgggactcacctgaggagacagtgaccagggtgccacggccccagagatcgaagtaccgtcgacgttccgaagtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgttccgaagtccattcctgagcgggctggcaaggc

SEQ ID NO: 2027 - DNA, 495 bp, Artificial Sequence
  Synthetic Template Oligonucleotide for IgH VJ Locus
gcctccctcgcgccatcaggttccgaagcataacttggcctggtgcctggacagagaagactgggagggggctgcagtgggactcacctgaggagacagtgaccagggtgccacggccccagagatcgaagtaccgtcgacgttccgaagcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgttccgaagcataactctgagcgggctggcaaggc

SEQ ID NO: 2028 - DNA, 495 bp, Artificial Sequence
  Synthetic Template Oligonucleotide for IgH VJ Locus
gcctccctcgcgccatcaggttccgaaatatgctgtggcctggtgcctggacagagaagactgggagggggctgcagtgggactcacctgaggagacagtgaccagggtgccacggccccagagatcgaagtaccgtcgacgttccgaaatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgttccgaaatatgctgctgagcgggctggcaaggc

SEQ ID NO: 2029 - DNA, 495 bp, Artificial Sequence
  Synthetic Template Oligonucleotide for IgH VJ Locus
gcctccctcgcgccatcaggttccgaaaatcctgctggcctggtgcctggacagagaagactgggagggggctgcagtgggactcacctgaggagacagtgaccagggtgccacggccccagagatcgaagtaccgtcgacgttccgaaaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgttccgaaaatcctgcctgagcgggctggcaaggc

SEQ ID NO: 2030 - DNA, 495 bp, Artificial Sequence
  Synthetic Template Oligonucleotide for IgH VJ Locus
gcctccctcgcgccatcaggttccgaatgagaccttggcctggtgcctggacagagaagactgggagggggctgcagtgggactcacctgaggagacagtgaccagggtgccacggccccagagatcgaagtaccgtcgacgttccgaatgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggttccgaatgagacctctgagcgggctggcaaggc

SEQ ID NO: 2031 - DNA, 495 bp, Artificial Sequence
  Synthetic Template Oligonucleotide for IgH VJ Locus
gcctccctcgcgccatcaggttccgaagaatggactggcctggtgcctggacagagaagactgggagggggctgcagtgggactcacctgaggagacagtgaccagggtgccacggccccagagatcgaagtaccgtcgacgttccgaagaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgttccgaagaatggacctgagcgggctggcaaggc

SEQ ID NO: 2032 - DNA, 495 bp, Artificial Sequence
  Synthetic Template Oligonucleotide for IgH VJ Locus
gcctccctcgcgccatcaggttccgaacacatggatggcctggtgcctggacagagaagactgggagggggctgcagtgggactcacctgaggagacagtgaccagggtgccacggccccagagatcgaagtaccgtcgacgttccgaacacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgttccgaacacatggactgagcgggctggcaaggc

SEQ ID NO: 2033 - DNA, 495 bp, Artificial Sequence
  Synthetic Template Oligonucleotide for IgH VJ Locus
gcctccctcgcgccatcaggttccgaattgaccattggcctggtgcctggacagagaagactgggagggggctgcagtgggactcacctgaggagacagtgaccagggtgccacggccccagagatcgaagtaccgtcgacgttccgaattgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgttccgaattgaccatctgagcgggctggcaaggc

SEQ ID NO: 2034 - DNA, 495 bp, Artificial Sequence
  Synthetic Template Oligonucleotide for IgH VJ Locus
gcctccctcgcgccatcaggttccgaaaagccatctggcctggtgcctggacagagaagactgggagggggctgcagtgggactcacctgaggagacagtgaccagggtgccacggccccagagatcgaagtaccgtcgacgttccgaaaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgttccgaaaagccatcctgagcgggctggcaaggc

SEQ ID NO: 2035 - DNA, 495 bp, Artificial Sequence
  Synthetic Template Oligonucleotide for IgH VJ Locus
gcctccctcgcgccatcaggttccgaatccatgtgtggcctggtgcctggacagagaagactgggagggggctgcagtgggactcacctgaggagacagtgaccagggtgccacggccccagagatcgaagtaccgtcgacgttccgaatccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgttccgaatccatgtgctgagcgggctggcaaggc

SEQ ID NO: 2036 - DNA, 495 bp, Artificial Sequence
  Synthetic Template Oligonucleotide for IgH VJ Locus
gcctccctcgcgccatcaggttccgaacaagtcactggcctggtgcctggacagagaagactgggagggggctgcagtgggactcacctgaggagacagtgaccagggtgccacggccccagagatcgaagtaccgtcgacgttccgaacaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgttccgaacaagtcacctgagcgggctggcaaggc

SEQ ID NO: 2037 - DNA, 495 bp, Artificial Sequence
  Synthetic Template Oligonucleotide for IgH VJ Locus
gcctccctcgcgccatcaggttccgaactgcaatctggcctggtgcctggacagagaagactgggagggggctgcagtgggactcacctgaggagacagtgaccagggtgccacggccccagagatcgaagtaccgtcgacgttccgaactgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgttccgaactgcaatcctgagcgggctggcaaggc

SEQ ID NO: 2038 - DNA, 495 bp, Artificial Sequence
  Synthetic Template Oligonucleotide for IgH VJ Locus
gcctccctcgcgccatcaggttccgaaatcgacgatggcctggtgcctggacagagaagactgggagggggctgcagtgggactcacctgaggagacagtgaccagggtgccacggccccagagatcgaagtaccgtcgacgttccgaaatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgttccgaaatcgacgactgagcgggctggcaaggc

SEQ ID NO: 2039 - DNA, 495 bp, Artificial Sequence
  Synthetic Template Oligonucleotide for IgH VJ Locus
gcctccctcgcgccatcaggttccgaaacagactgtggcctggtgcctggacagagaagactgggagggggctgcagtgggactcacctgaggagacagtgaccagggtgccacggccccagagatcgaagtaccgtcgacgttccgaaacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagttccgaaacagactgctgagcgggctggcaaggc

SEQ ID NO: 2040 - DNA, 495 bp, Artificial Sequence
  Synthetic Template Oligonucleotide for IgH VJ Locus
gcctccctcgcgccatcaggttccgaaccttatagtggcctggtgcctggacagagaagactgggagggggctgcagtgggactcacctgaggagacagtgaccagggtgccacggccccagagatcgaagtaccgtcgacgttccgaaccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgttccgaaccttatagctgagcgggctggcaaggc

SEQ ID NO: 2041 - DNA, 495 bp, Artificial Sequence
  Synthetic Template Oligonucleotide for IgH VJ Locus
gcctccctcgcgccatcaggttccgaatacgcgtttggcctggtgcctggacagagaagactgggagggggctgcagtgggactcacctgaggagacagtgaccagggtgccacggccccagagatcgaagtaccgtcgacgttccgaatacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgttccgaatacgcgttctgagcgggctggcaaggc

SEQ ID NO: 2042 - DNA, 495 bp, Artificial Sequence
  Synthetic Template Oligonucleotide for IgH VJ Locus
gcctccctcgcgccatcaggttccgaactataaggtggcctggtgcctggacagagaagactgggagggggctgcagtgggactcacctgaggagacagtgaccagggtgccacggccccagagatcgaagtaccgtcgacgttccgaactataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggttccgaactataaggctgagcgggctggcaaggc

SEQ ID NO: 2043 - DNA, 495 bp, Artificial Sequence
  Synthetic Template Oligonucleotide for IgH VJ Locus
gcctccctcgcgccatcaggttccgaatcttagtctggcctggtgcctggacagagaagactgggagggggctgcagtgggactcacctgaggagacagtgaccagggtgccacggccccagagatcgaagtaccgtcgacgttccgaatcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgttccgaatcttagtcctgagcgggctggcaaggc

SEQ ID NO: 2044 - DNA, 495 bp, Artificial Sequence
  Synthetic Template Oligonucleotide for IgH VJ Locus
gcctccctcgcgccatcaggttccgaatgtctgcatggcctggtgcctggacagagaagactgggagggggctgcagtgggactcacctgaggagacagtgaccagggtgccacggccccagagatcgaagtaccgtcgacgttccgaatgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgttccgaatgtctgcactgagcgggctggcaaggc

SEQ ID NO: 2045 - DNA, 495 bp, Artificial Sequence
  Synthetic Template Oligonucleotide for IgH VJ Locus
gcctccctcgcgccatcaggttccgaagccattaatggcctggtgcctggacagagaagactgggagggggctgcagtgggactcacctgaggagacagtgaccagggtgccacggccccagagatcgaagtaccgtcgacgttccgaagccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgttccgaagccattaactgagcgggctggcaaggc

SEQ ID NO: 2046 - DNA, 495 bp, Artificial Sequence
  Synthetic Template Oligonucleotide for IgH VJ Locus
gcctccctcgcgccatcaggttccgaagactaagatggcctggtgcctggacagagaagactgggagggggctgcagtgggactcacctgaggagacagtgaccagggtgccacggccccagagatcgaagtaccgtcgacgttccgaagactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggttccgaagactaagactgagcgggctggcaaggc

SEQ ID NO: 2047 - DNA, 495 bp, Artificial Sequence
  Synthetic Template Oligonucleotide for IgH VJ Locus
gcctccctcgcgccatcaggttccgaaaggttgcttggcctggtgcctggacagagaagactgggagggggctgcagtgggactcacctgaggagacagtgaccagggtgccacggccccagagatcgaagtaccgtcgacgttccgaaaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggttccgaaaggttgctctgagcgggctggcaaggc

SEQ ID NO: 2048 - DNA, 495 bp, Artificial Sequence
  Synthetic Template Oligonucleotide for IgH VJ Locus
gcctccctcgcgccatcaggttccgaactcgagaatggcctggtgcctggacagagaagactgggagggggctgcagtgggactcacctgaggagacagtgaccagggtgccacggccccagagatcgaagtaccgtcgacgttccgaactcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgttccgaactcgagaactgagcgggctggcaaggc

SEQ ID NO: 2049 - DNA, 495 bp, Artificial Sequence
  Synthetic Template Oligonucleotide for IgH VJ Locus
gcctccctcgcgccatcaggttccgaattaatggctggcctggtgcctggacagagaagactgggagggggctgcagtgggactcacctgaggagacagtgaccagggtgccacggccccagagatcgaagtaccgtcgacgttccgaattaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgttccgaattaatggcctgagcgggctggcaaggc

SEQ ID NO: 2050 - DNA, 495 bp, Artificial Sequence
  Synthetic Template Oligonucleotide for IgH VJ Locus
gcctccctcgcgccatcaggttccgaatgcagacatggcctggtgcctggacagagaagactgggagggggctgcagtgggactcacctgaggagacagtgaccagggtgccacggccccagagatcgaagtaccgtcgacgttccgaatgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagttccgaatgcagacactgagcgggctggcaaggc

SEQ ID NO: 2051 - DNA, 495 bp, Artificial Sequence
  Synthetic Template Oligonucleotide for IgH VJ Locus
gcctccctcgcgccatcaggttccgaatcactgagtggcctggtgcctggacagagaagactgggagggggctgcagtgggactcacctgaggagacagtgaccagggtgccacggccccagagatcgaagtaccgtcgacgttccgaatcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgttccgaatcactgagctgagcgggctggcaaggc

SEQ ID NO: 2052 - DNA, 495 bp, Artificial Sequence
  Synthetic Template Oligonucleotide for IgH VJ Locus
gcctccctcgcgccatcaggttccgaagagtacgttggcctggtgcctggacagagaagactgggagggggctgcagtgggactcacctgaggagacagtgaccagggtgccacggccccagagatcgaagtaccgtcgacgttccgaagagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgttccgaagagtacgtctgagcgggctggcaaggc

SEQ ID NO: 2053 - DNA, 495 bp, Artificial Sequence
  Synthetic Template Oligonucleotide for IgH VJ Locus
gcctccctcgcgccatcaggttccgaaatacgccatggcctggtgcctggacagagaagactgggagggggctgcagtgggactcacctgaggagacagtgaccagggtgccacggccccagagatcgaagtaccgtcgacgttccgaaatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgttccgaaatacgccactgagcgggctggcaaggc

SEQ ID NO: 2054 - DNA, 495 bp, Artificial Sequence
  Synthetic Template Oligonucleotide for IgH VJ Locus
gcctccctcgcgccatcaggttccgaatcgcatcatggcctggtgcctggacagagaagactgggagggggctgcagtgggactcacctgaggagacagtgaccagggtgccacggccccagagatcgaagtaccgtcgacgttccgaatcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgttccgaatcgcatcactgagcgggctggcaaggc

SEQ ID NO: 2055 - DNA, 495 bp, Artificial Sequence
  Synthetic Template Oligonucleotide for IgH VJ Locus
gcctccctcgcgccatcaggttccgaacgcttaattggcctggtgcctggacagagaagactgggagggggctgcagtgggactcacctgaggagacagtgaccagggtgccacggccccagagatcgaagtaccgtcgacgttccgaacgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgttccgaacgcttaatctgagcgggctggcaaggc

SEQ ID NO: 2056 - DNA, 495 bp, Artificial Sequence
  Synthetic Template Oligonucleotide for IgH VJ Locus
gcctccctcgcgccatcaggttccgaatggttatctggcctggtgcctggacagagaagactgggagggggctgcagtgggactcacctgaggagacagtgaccagggtgccacggccccagagatcgaagtaccgtcgacgttccgaatggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgttccgaatggttatcctgagcgggctggcaaggc

SEQ ID NO: 2057 - DNA, 495 bp, Artificial Sequence
  Synthetic Template Oligonucleotide for IgH VJ Locus
gcctccctcgcgccatcaggttccgaaggattgcttggcctggtgcctggacagagaagactgggagggggctgcagtgggactcacctgaggagacagtgaccagggtgccacggccccagagatcgaagtaccgtcgacgttccgaaggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgttccgaaggattgctctgagcgggctggcaaggc

SEQ ID NO: 2058 - DNA, 495 bp, Artificial Sequence
  Synthetic Template Oligonucleotide for IgH VJ Locus
gcctccctcgcgccatcaggttccgaactcagtgatggcctggtgcctggacagagaagactgggagggggctgcagtgggactcacctgaggagacagtgaccagggtgccacggccccagagatcgaagtaccgtcgacgttccgaactcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgttccgaactcagtgactgagcgggctggcaaggc

SEQ ID NO: 2059 - DNA, 495 bp, Artificial Sequence
  Synthetic Template Oligonucleotide for IgH VJ Locus
gcctccctcgcgccatcaggttccgaaacgtactctggcctggtgcctggacagagaagactgggagggggctgcagtgggactcacctgaggagacagtgaccagggtgccacggccccagagatcgaagtaccgtcgacgttccgaaacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgttccgaaacgtactcctgagcgggctggcaaggc

SEQ ID NO: 2060 - DNA, 495 bp, Artificial Sequence
  Synthetic Template Oligonucleotide for IgH VJ Locus
gcctccctcgcgccatcaggttccgaatgatgcgatggcctggtgcctggacagagaagactgggagggggctgcagtgggactcacctgaggagacagtgaccagggtgccacggccccagagatcgaagtaccgtcgacgttccgaatgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgttccgaatgatgcgactgagcgggctggcaaggc

SEQ ID NO: 2061 - DNA, 495 bp, Artificial Sequence
  Synthetic Template Oligonucleotide for IgH VJ Locus
gcctccctcgcgccatcaggttccgaaattaagcgtggcctggtgcctggacagagaagactgggagggggctgcagtgggactcacctgaggagacagtgaccagggtgccacggccccagagatcgaagtaccgtcgacgttccgaaattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgttccgaaattaagcgctgagcgggctggcaaggc

SEQ ID NO: 2062 - DNA, 495 bp, Artificial Sequence
  Synthetic Template Oligonucleotide for IgH VJ Locus
gcctccctcgcgccatcaggttccgaaagcaatcctggcctggtgcctggacagagaagactgggagggggctgcagtgggactcacctgaggagacagtgaccagggtgccacggccccagagatcgaagtaccgtcgacgttccgaaagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgttccgaaagcaatccctgagcgggctggcaaggc

SEQ ID NO: 2063 - DNA, 495 bp, Artificial Sequence
  Synthetic Template Oligonucleotide for IgH VJ Locus
gcctccctcgcgccatcaggttccgaagcttagtatggcctggtgcctggacagagaagactgggagggggctgcagtgggactcacctgaggagacagtgaccagggtgccacggccccagagatcgaagtaccgtcgacgttccgaagcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagttccgaagcttagtactgagcgggctggcaaggc

SEQ ID NO: 2064 - DNA, 495 bp, Artificial Sequence
  Synthetic Template Oligonucleotide for IgH VJ Locus
gcctccctcgcgccatcaggttccgaatgaccttgtggcctggtgcctggacagagaagactgggagggggctgcagtgggactcacctgaggagacagtgaccagggtgccacggccccagagatcgaagtaccgtcgacgttccgaatgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgttccgaatgaccttgctgagcgggctggcaaggc

SEQ ID NO: 2065 - DNA, 495 bp, Artificial Sequence
  Synthetic Template Oligonucleotide for IgH VJ Locus
gcctccctcgcgccatcaggttccgaacaaggtcatggcctggtgcctggacagagaagactgggagggggctgcagtgggactcacctgaggagacagtgaccagggtgccacggccccagagatcgaagtaccgtcgacgttccgaacaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgttccgaacaaggtcactgagcgggctggcaaggc

SEQ ID NO: 2066 - DNA, 495 bp, Artificial Sequence
  Synthetic Template Oligonucleotide for IgH VJ Locus
gcctccctcgcgccatcaggttccgaacactgtactggcctggtgcctggacagagaagactgggagggggctgcagtgggactcacctgaggagacagtgaccagggtgccacggccccagagatcgaagtaccgtcgacgttccgaacactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgttccgaacactgtacctgagcgggctggcaaggc

SEQ ID NO: 2067 - DNA, 495 bp, Artificial Sequence
  Synthetic Template Oligonucleotide for IgH VJ Locus
gcctccctcgcgccatcaggttccgaagatgatcctggcctggtgcctggacagagaagactgggagggggctgcagtgggactcacctgaggagacagtgaccagggtgccacggccccagagatcgaagtaccgtcgacgttccgaagatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggttccgaagatgatccctgagcgggctggcaaggc

SEQ ID NO: 2068 - DNA, 495 bp, Artificial Sequence
  Synthetic Template Oligonucleotide for IgH VJ Locus
gcctccctcgcgccatcaggttccgaacgccaatatggcctggtgcctggacagagaagactgggagggggctgcagtgggactcacctgaggagacagtgaccagggtgccacggccccagagatcgaagtaccgtcgacgttccgaacgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggttccgaacgccaatactgagcgggctggcaaggc

SEQ ID NO: 2069 - DNA, 495 bp, Artificial Sequence
  Synthetic Template Oligonucleotide for IgH VJ Locus
gcctccctcgcgccatcaggttccgaatcaagccttggcctggtgcctggacagagaagactgggagggggctgcagtgggactcacctgaggagacagtgaccagggtgccacggccccagagatcgaagtaccgtcgacgttccgaatcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagttccgaatcaagcctctgagcgggctggcaaggc

SEQ ID NO: 2070 - DNA, 495 bp, Artificial Sequence
  Synthetic Template Oligonucleotide for IgH VJ Locus
gcctccctcgcgccatcaggttccgaaacgtgtgttggcctggtgcctggacagagaagactgggagggggctgcagtgggactcacctgaggagacagtgaccagggtgccacggccccagagatcgaagtaccgtcgacgttccgaaacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggttccgaaacgtgtgtctgagcgggctggcaaggc

SEQ ID NO: 2071 - DNA, 495 bp, Artificial Sequence
  Synthetic Template Oligonucleotide for IgH VJ Locus
gcctccctcgcgccatcaggttccgaatccgtctatggcctggtgcctggacagagaagactgggagggggctgcagtgggactcacctgaggagacagtgaccagggtgccacggccccagagatcgaagtaccgtcgacgttccgaatccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggttccgaatccgtctactgagcgggctggcaaggc

SEQ ID NO: 2072 - DNA, 495 bp, Artificial Sequence
  Synthetic Template Oligonucleotide for IgH VJ Locus
gcctccctcgcgccatcaggttccgaaaagagctgtggcctggtgcctggacagagaagactgggagggggctgcagtgggactcacctgaggagacagtgaccagggtgccacggccccagagatcgaagtaccgtcgacgttccgaaaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggttccgaaaagagctgctgagcgggctggcaaggc

SEQ ID NO: 2073 - DNA, 495 bp, Artificial Sequence
  Synthetic Template Oligonucleotide for IgH VJ Locus
gcctccctcgcgccatcaggttccgaatatcgctctggcctggtgcctggacagagaagactgggagggggctgcagtgggactcacctgaggagacagtgaccagggtgccacggccccagagatcgaagtaccgtcgacgttccgaatatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggttccgaatatcgctcctgagcgggctggcaaggc

SEQ ID NO: 2074 - DNA, 495 bp, Artificial Sequence
  Synthetic Template Oligonucleotide for IgH VJ Locus
gcctccctcgcgccatcaggttccgaatcagatgctggcctggtgcctggacagagaagactgggagggggctgcagtgggactcacctgaggagacagtgaccagggtgccacggccccagagatcgaagtaccgtcgacgttccgaatcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgttccgaatcagatgcctgagcgggctggcaaggc

SEQ ID NO: 2075 - DNA, 495 bp, Artificial Sequence
  Synthetic Template Oligonucleotide for IgH VJ Locus
gcctccctcgcgccatcaggttccgaagtgtagcatggcctggtgcctggacagagaagactgggagggggctgcagtgggactcacctgaggagacagtgaccagggtgccacggccccagagatcgaagtaccgtcgacgttccgaagtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggttccgaagtgtagcactgagcgggctggcaaggc

SEQ ID NO: 2076 - DNA, 495 bp, Artificial Sequence
  Synthetic Template Oligonucleotide for IgH VJ Locus
gcctccctcgcgccatcaggttccgaatggcagtttggcctggtgcctggacagagaagactgggagggggctgcagtgggactcacctgaggagacagtgaccagggtgccacggccccagagatcgaagtaccgtcgacgttccgaatggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggttccgaatggcagttctgagcgggctggcaaggc

SEQ ID NO: 2077 - DNA, 495 bp, Artificial Sequence
  Synthetic Template Oligonucleotide for IgH VJ Locus
gcctccctcgcgccatcaggttccgaacagtccaatggcctggtgcctggacagagaagactgggagggggctgcagtgggactcacctgaggagacagtgaccagggtgccacggccccagagatcgaagtaccgtcgacgttccgaacagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgttccgaacagtccaactgagcgggctggcaaggc

SEQ ID NO: 2078 - DNA, 495 bp, Artificial Sequence
  Synthetic Template Oligonucleotide for IgH VJ Locus
gcctccctcgcgccatcaggttccgaagtgtctactggcctggtgcctggacagagaagactgggagggggctgcagtgggactcacctgaggagacagtgaccagggtgccacggccccagagatcgaagtaccgtcgacgttccgaagtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggttccgaagtgtctacctgagcgggctggcaaggc

SEQ ID NO: 2079 - DNA, 495 bp, Artificial Sequence
  Synthetic Template Oligonucleotide for IgH VJ Locus
gcctccctcgcgccatcaggttccgaagtacagtgtggcctggtgcctggacagagaagactgggagggggctgcagtgggactcacctgaggagacagtgaccagggtgccacggccccagagatcgaagtaccgtcgacgttccgaagtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggttccgaagtacagtgctgagcgggctggcaaggc

SEQ ID NO: 2080 - DNA, 495 bp, Artificial Sequence
  Synthetic Template Oligonucleotide for IgH VJ Locus
gcctccctcgcgccatcaggttccgaaggatcatctggcctggtgcctggacagagaagactgggagggggctgcagtgggactcacctgaggagacagtgaccagggtgccacggccccagagatcgaagtaccgtcgacgttccgaaggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggttccgaaggatcatcctgagcgggctggcaaggc

SEQ ID NO: 2081 - DNA, 495 bp, Artificial Sequence
  Synthetic Template Oligonucleotide for IgH VJ Locus
gcctccctcgcgccatcaggttccgaatattggcgtggcctggtgcctggacagagaagactgggagggggctgcagtgggactcacctgaggagacagtgaccagggtgccacggccccagagatcgaagtaccgtcgacgttccgaatattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagttccgaatattggcgctgagcgggctggcaaggc

SEQ ID NO: 2082 - DNA, 495 bp, Artificial Sequence
  Synthetic Template Oligonucleotide for IgH VJ Locus
gcctccctcgcgccatcaggttccgaaaggcttgatggcctggtgcctggacagagaagactgggagggggctgcagtgggactcacctgaggagacagtgaccagggtgccacggccccagagatcgaagtaccgtcgacgttccgaaaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgttccgaaaggcttgactgagcgggctggcaaggc

SEQ ID NO: 2083 - DNA, 495 bp, Artificial Sequence
  Synthetic Template Oligonucleotide for IgH VJ Locus
gcctccctcgcgccatcaggttccgaaacacacgttggcctggtgcctggacagagaagactgggagggggctgcagtgggactcacctgaggagacagtgaccagggtgccacggccccagagatcgaagtaccgtcgacgttccgaaacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgttccgaaacacacgtctgagcgggctggcaaggc

SEQ ID NO: 2084 - DNA, 495 bp, Artificial Sequence
  Synthetic Template Oligonucleotide for IgH VJ Locus
gcctccctcgcgccatcaggttccgaatagacggatggcctggtgcctggacagagaagactgggagggggctgcagtgggactcacctgaggagacagtgaccagggtgccacggccccagagatcgaagtaccgtcgacgttccgaatagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagttccgaatagacggactgagcgggctggcaaggc

SEQ ID NO: 2085 - DNA, 495 bp, Artificial Sequence
  Synthetic Template Oligonucleotide for IgH VJ Locus
gcctccctcgcgccatcaggttccgaagagcgatatggcctggtgcctggacagagaagactgggagggggctgcagtgggactcacctgaggagacagtgaccagggtgccacggccccagagatcgaagtaccgtcgacgttccgaagagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgttccgaagagcgatactgagcgggctggcaaggc

SEQ ID NO: 2086 - DNA, 495 bp, Artificial Sequence
  Synthetic Template Oligonucleotide for IgH VJ Locus
gcctccctcgcgccatcaggttccgaagcatctgatggcctggtgcctggacagagaagactgggagggggctgcagtgggactcacctgaggagacagtgaccagggtgccacggccccagagatcgaagtaccgtcgacgttccgaagcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagttccgaagcatctgactgagcgggctggcaaggc

SEQ ID NO: 2087 - DNA, 495 bp, Artificial Sequence
  Synthetic Template Oligonucleotide for IgH VJ Locus
gcctccctcgcgccatcaggttccgaatgctacactggcctggtgcctggacagagaagactgggagggggctgcagtgggactcacctgaggagacagtgaccagggtgccacggccccagagatcgaagtaccgtcgacgttccgaatgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggttccgaatgctacacctgagcgggctggcaaggc

SEQ ID NO: 2088 - DNA, 495 bp, Artificial Sequence
  Synthetic Template Oligonucleotide for IgH VJ Locus
gcctccctcgcgccatcaggttccgaaaactgccatggcctggtgcctggacagagaagactgggagggggctgcagtgggactcacctgaggagacagtgaccagggtgccacggccccagagatcgaagtaccgtcgacgttccgaaaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgttccgaaaactgccactgagcgggctggcaaggc

SEQ ID NO: 2089 - DNA, 495 bp, Artificial Sequence
  Synthetic Template Oligonucleotide for IgH VJ Locus
gcctccctcgcgccatcaggttccgaattggactgtggcctggtgcctggacagagaagactgggagggggctgcagtgggactcacctgaggagacagtgaccagggtgccacggccccagagatcgaagtaccgtcgacgttccgaattggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggttccgaattggactgctgagcgggctggcaaggc

SEQ ID NO: 2090 - DNA, 495 bp, Artificial Sequence
  Synthetic Template Oligonucleotide for IgH VJ Locus
gcctccctcgcgccatcaggttccgaatcggtacttggcctggtgcctggacagagaagactgggagggggctgcagtgggactcacctgaggagacagtgaccagggtgccacggccccagagatcgaagtaccgtcgacgttccgaatcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggttccgaatcggtactctgagcgggctggcaaggc

SEQ ID NO: 2091 - DNA, 495 bp, Artificial Sequence
  Synthetic Template Oligonucleotide for IgH VJ Locus
gcctccctcgcgccatcaggttccgaaccatggattggcctggtgcctggacagagaagactgggagggggctgcagtgggactcacctgaggagacagtgaccagggtgccacggccccagagatcgaagtaccgtcgacgttccgaaccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgttccgaaccatggatctgagcgggctggcaaggc

SEQ ID NO: 2092 - DNA, 495 bp, Artificial Sequence
  Synthetic Template Oligonucleotide for IgH VJ Locus
gcctccctcgcgccatcaggttccgaaacgaagattggcctggtgcctggacagagaagactgggagggggctgcagtgggactcacctgaggagacagtgaccagggtgccacggccccagagatcgaagtaccgtcgacgttccgaaacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagttccgaaacgaagatctgagcgggctggcaaggc

SEQ ID NO: 2093 - DNA, 495 bp, Artificial Sequence
  Synthetic Template Oligonucleotide for IgH VJ Locus
gcctccctcgcgccatcaggttccgaaactgtggatggcctggtgcctggacagagaagactgggagggggctgcagtgggactcacctgaggagacagtgaccagggtgccacggccccagagatcgaagtaccgtcgacgttccgaaactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgttccgaaactgtggactgagcgggctggcaaggc

SEQ ID NO: 2094 - DNA, 495 bp, Artificial Sequence
  Synthetic Template Oligonucleotide for IgH VJ Locus
gcctccctcgcgccatcaggttccgaaggtgtcattggcctggtgcctggacagagaagactgggagggggctgcagtgggactcacctgaggagacagtgaccagggtgccacggccccagagatcgaagtaccgtcgacgttccgaaggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgttccgaaggtgtcatctgagcgggctggcaaggc

SEQ ID NO: 2095 - DNA, 495 bp, Artificial Sequence
  Synthetic Template Oligonucleotide for IgH VJ Locus
gcctccctcgcgccatcaggttccgaatcgtgaagtggcctggtgcctggacagagaagactgggagggggctgcagtgggactcacctgaggagacagtgaccagggtgccacggccccagagatcgaagtaccgtcgacgttccgaatcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggttccgaatcgtgaagctgagcgggctggcaaggc

SEQ ID NO: 2096 - DNA, 495 bp, Artificial Sequence
  Synthetic Template Oligonucleotide for IgH VJ Locus
gcctccctcgcgccatcaggttccgaacactagcttggcctggtgcctggacagagaagactgggagggggctgcagtgggactcacctgaggagacagtgaccagggtgccacggccccagagatcgaagtaccgtcgacgttccgaacactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagttccgaacactagctctgagcgggctggcaaggc

SEQ ID NO: 2097 - DNA, 495 bp, Artificial Sequence
  Synthetic Template Oligonucleotide for IgH VJ Locus
gcctccctcgcgccatcaggttccgaaggtcaacttggcctggtgcctggacagagaagactgggagggggctgcagtgggactcacctgaggagacagtgaccagggtgccacggccccagagatcgaagtaccgtcgacgttccgaaggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagttccgaaggtcaactctgagcgggctggcaaggc

SEQ ID NO: 2098 - DNA, 495 bp, Artificial Sequence
  Synthetic Template Oligonucleotide for IgH VJ Locus
gcctccctcgcgccatcaggttccgaatacgtacgtggcctggtgcctggacagagaagactgggagggggctgcagtgggactcacctgaggagacagtgaccagggtgccacggccccagagatcgaagtaccgtcgacgttccgaatacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgttccgaatacgtacgctgagcgggctggcaaggc

SEQ ID NO: 2099 - DNA, 495 bp, Artificial Sequence
  Synthetic Template Oligonucleotide for IgH VJ Locus
gcctccctcgcgccatcaggttccgaaatgacacctggcctggtgcctggacagagaagactgggagggggctgcagtgggactcacctgaggagacagtgaccagggtgccacggccccagagatcgaagtaccgtcgacgttccgaaatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggttccgaaatgacaccctgagcgggctggcaaggc

SEQ ID NO: 2100 - DNA, 495 bp, Artificial Sequence
  Synthetic Template Oligonucleotide for IgH VJ Locus
gcctccctcgcgccatcaggttccgaacttcacgatggcctggtgcctggacagagaagactgggagggggctgcagtgggactcacctgaggagacagtgaccagggtgccacggccccagagatcgaagtaccgtcgacgttccgaacttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgttccgaacttcacgactgagcgggctggcaaggc

SEQ ID NO: 2101 - DNA, 495 bp, Artificial Sequence
  Synthetic Template Oligonucleotide for IgH VJ Locus
gcctccctcgcgccatcaggttccgaaagaatcagtggcctggtgcctggacagagaagactgggagggggctgcagtgggactcacctgaggagacagtgaccagggtgccacggccccagagatcgaagtaccgtcgacgttccgaaagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgttccgaaagaatcagctgagcgggctggcaaggc

SEQ ID NO: 2102 - DNA, 495 bp, Artificial Sequence
  Synthetic Template Oligonucleotide for IgH VJ Locus
gcctccctcgcgccatcaggttccgaaagttatgctggcctggtgcctggacagagaagactgggagggggctgcagtgggactcacctgaggagacagtgaccagggtgccacggccccagagatcgaagtaccgtcgacgttccgaaagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagttccgaaagttatgcctgagcgggctggcaaggc

SEQ ID NO: 2103 - DNA, 495 bp, Artificial Sequence
  Synthetic Template Oligonucleotide for IgH VJ Locus
gcctccctcgcgccatcaggttccgaaaggtctcatggcctggtgcctggacagagaagactgggagggggctgcagtgggactcacctgaggagacagtgaccagggtgccacggccccagagatcgaagtaccgtcgacgttccgaaaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgttccgaaaggtctcactgagcgggctggcaaggc

SEQ ID NO: 2104 - DNA, 495 bp, Artificial Sequence
  Synthetic Template Oligonucleotide for IgH VJ Locus
gcctccctcgcgccatcaggttccgaagtcatagttggcctggtgcctggacagagaagactgggagggggctgcagtgggactcacctgaggagacagtgaccagggtgccacggccccagagatcgaagtaccgtcgacgttccgaagtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgttccgaagtcatagtctgagcgggctggcaaggc

SEQ ID NO: 2105 - DNA, 495 bp, Artificial Sequence
  Synthetic Template Oligonucleotide for IgH VJ Locus
gcctccctcgcgccatcaggttccgaagtgacttgtggcctggtgcctggacagagaagactgggagggggctgcagtgggactcacctgaggagacagtgaccagggtgccacggccccagagatcgaagtaccgtcgacgttccgaagtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggttccgaagtgacttgctgagcgggctggcaaggc

SEQ ID NO: 2106 - DNA, 495 bp, Artificial Sequence
  Synthetic Template Oligonucleotide for IgH VJ Locus
gcctccctcgcgccatcaggttccgaagattgcagtggcctggtgcctggacagagaagactgggagggggctgcagtgggactcacctgaggagacagtgaccagggtgccacggccccagagatcgaagtaccgtcgacgttccgaagattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgttccgaagattgcagctgagcgggctggcaaggc

SEQ ID NO: 2107 - DNA, 495 bp, Artificial Sequence
  Synthetic Template Oligonucleotide for IgH VJ Locus
gcctccctcgcgccatcaggttccgaaactatgactggcctggtgcctggacagagaagactgggagggggctgcagtgggactcacctgaggagacagtgaccagggtgccacggccccagagatcgaagtaccgtcgacgttccgaaactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgttccgaaactatgacctgagcgggctggcaaggc

SEQ ID NO: 2108 - DNA, 495 bp, Artificial Sequence
  Synthetic Template Oligonucleotide for IgH VJ Locus
gcctccctcgcgccatcaggttccgaaatggtcaatggcctggtgcctggacagagaagactgggagggggctgcagtgggactcacctgaggagacagtgaccagggtgccacggccccagagatcgaagtaccgtcgacgttccgaaatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgttccgaaatggtcaactgagcgggctggcaaggc

SEQ ID NO: 2109 - DNA, 495 bp, Artificial Sequence
  Synthetic Template Oligonucleotide for IgH VJ Locus
gcctccctcgcgccatcaggttccgaagatggctttggcctggtgcctggacagagaagactgggagggggctgcagtgggactcacctgaggagacagtgaccagggtgccacggccccagagatcgaagtaccgtcgacgttccgaagatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgttccgaagatggcttctgagcgggctggcaaggc

SEQ ID NO: 2110 - DNA, 495 bp, Artificial Sequence
  Synthetic Template Oligonucleotide for IgH VJ Locus
gcctccctcgcgccatcaggttccgaaagcatatgtggcctggtgcctggacagagaagactgggagggggctgcagtgggactcacctgaggagacagtgaccagggtgccacggccccagagatcgaagtaccgtcgacgttccgaaagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgttccgaaagcatatgctgagcgggctggcaaggc

SEQ ID NO: 2111 - DNA, 495 bp, Artificial Sequence
  Synthetic Template Oligonucleotide for IgH VJ Locus
gcctccctcgcgccatcaggttccgaacatatgcttggcctggtgcctggacagagaagactgggagggggctgcagtgggactcacctgaggagacagtgaccagggtgccacggccccagagatcgaagtaccgtcgacgttccgaacatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggttccgaacatatgctctgagcgggctggcaaggc

SEQ ID NO: 2112 - DNA, 495 bp, Artificial Sequence
  Synthetic Template Oligonucleotide for IgH VJ Locus
gcctccctcgcgccatcaggttccgaatcgtcgattggcctggtgcctggacagagaagactgggagggggctgcagtgggactcacctgaggagacagtgaccagggtgccacggccccagagatcgaagtaccgtcgacgttccgaatcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgttccgaatcgtcgatctgagcgggctggcaaggc

SEQ ID NO: 2113 - DNA, 495 bp, Artificial Sequence
  Synthetic Template Oligonucleotide for IgH VJ Locus
gcctccctcgcgccatcaggttccgaacagtctgttggcctggtgcctggacagagaagactgggagggggctgcagtgggactcacctgaggagacagtgaccagggtgccacggccccagagatcgaagtaccgtcgacgttccgaacagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgttccgaacagtctgtctgagcgggctggcaaggc

SEQ ID NO: 2114 - DNA, 495 bp, Artificial Sequence
  Synthetic Template Oligonucleotide for IgH VJ Locus
gcctccctcgcgccatcaggttccgaaaacgcgtatggcctggtgcctggacagagaagactgggagggggctgcagtgggactcacctgaggagacagtgaccagggtgccacggccccagagatcgaagtaccgtcgacgttccgaaaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggttccgaaaacgcgtactgagcgggctggcaaggc

SEQ ID NO: 2115 - DNA, 495 bp, Artificial Sequence
  Synthetic Template Oligonucleotide for IgH VJ Locus
gcctccctcgcgccatcaggttccgaagtagttcgtggcctggtgcctggacagagaagactgggagggggctgcagtgggactcacctgaggagacagtgaccagggtgccacggccccagagatcgaagtaccgtcgacgttccgaagtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgttccgaagtagttcgctgagcgggctggcaaggc

SEQ ID NO: 2116 - DNA, 495 bp, Artificial Sequence
  Synthetic Template Oligonucleotide for IgH VJ Locus
gcctccctcgcgccatcaggttccgaacgaactactggcctggtgcctggacagagaagactgggagggggctgcagtgggactcacctgaggagacagtgaccagggtgccacggccccagagatcgaagtaccgtcgacgttccgaacgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgttccgaacgaactacctgagcgggctggcaaggc

SEQ ID NO: 2117 - DNA, 495 bp, Artificial Sequence
  Synthetic Template Oligonucleotide for IgH VJ Locus
gcctccctcgcgccatcaggttccgaattaacgtctggcctggtgcctggacagagaagactgggagggggctgcagtgggactcacctgaggagacagtgaccagggtgccacggccccagagatcgaagtaccgtcgacgttccgaattaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgttccgaattaacgtcctgagcgggctggcaaggc

SEQ ID NO: 2118 - DNA, 495 bp, Artificial Sequence
  Synthetic Template Oligonucleotide for IgH VJ Locus
gcctccctcgcgccatcaggttccgaaagcaaccttggcctggtgcctggacagagaagactgggagggggctgcagtgggactcacctgaggagacagtgaccagggtgccacggccccagagatcgaagtaccgtcgacgttccgaaagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgttccgaaagcaacctctgagcgggctggcaaggc

SEQ ID NO: 2119 - DNA, 495 bp, Artificial Sequence
  Synthetic Template Oligonucleotide for IgH VJ Locus
gcctccctcgcgccatcaggttccgaattctcgagtggcctggtgcctggacagagaagactgggagggggctgcagtgggactcacctgaggagacagtgaccagggtgccacggccccagagatcgaagtaccgtcgacgttccgaattctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgttccgaattctcgagctgagcgggctggcaaggc

SEQ ID NO: 2120 - DNA, 495 bp, Artificial Sequence
  Synthetic Template Oligonucleotide for IgH VJ Locus
gcctccctcgcgccatcaggttccgaaactctacgtggcctggtgcctggacagagaagactgggagggggctgcagtgggactcacctgaggagacagtgaccagggtgccacggccccagagatcgaagtaccgtcgacgttccgaaactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgttccgaaactctacgctgagcgggctggcaaggc

SEQ ID NO: 2121 - DNA, 495 bp, Artificial Sequence
  Synthetic Template Oligonucleotide for IgH VJ Locus
gcctccctcgcgccatcaggttccgaataccggaatggcctggtgcctggacagagaagactgggagggggctgcagtgggactcacctgaggagacagtgaccagggtgccacggccccagagatcgaagtaccgtcgacgttccgaataccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgttccgaataccggaactgagcgggctggcaaggc

SEQ ID NO: 2122 - DNA, 495 bp, Artificial Sequence
  Synthetic Template Oligonucleotide for IgH VJ Locus
gcctccctcgcgccatcaggttccgaacgaattgctggcctggtgcctggacagagaagactgggagggggctgcagtgggactcacctgaggagacagtgaccagggtgccacggccccagagatcgaagtaccgtcgacgttccgaacgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgttccgaacgaattgcctgagcgggctggcaaggc

SEQ ID NO: 2123 - DNA, 495 bp, Artificial Sequence
  Synthetic Template Oligonucleotide for IgH VJ Locus
gcctccctcgcgccatcaggttccgaattcgctcatggcctggtgcctggacagagaagactgggagggggctgcagtgggactcacctgaggagacagtgaccagggtgccacggccccagagatcgaagtaccgtcgacgttccgaattcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagttccgaattcgctcactgagcgggctggcaaggc

SEQ ID NO: 2124 - DNA, 495 bp, Artificial Sequence
  Synthetic Template Oligonucleotide for IgH VJ Locus
gcctccctcgcgccatcaggttccgaagacgttaatggcctggtgcctggacagagaagactgggagggggctgcagtgggactcacctgaggagacagtgaccagggtgccacggccccagagatcgaagtaccgtcgacgttccgaagacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggttccgaagacgttaactgagcgggctggcaaggc

SEQ ID NO: 2125 - DNA, 495 bp, Artificial Sequence
  Synthetic Template Oligonucleotide for IgH VJ Locus
gcctccctcgcgccatcaggttccgaacgtagagttggcctggtgcctggacagagaagactgggagggggctgcagtgggactcacctgaggagacagtgaccagggtgccacggccccagagatcgaagtaccgtcgacgttccgaacgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgttccgaacgtagagtctgagcgggctggcaaggc

SEQ ID NO: 2126 - DNA, 495 bp, Artificial Sequence
  Synthetic Template Oligonucleotide for IgH VJ Locus
gcctccctcgcgccatcaggttccgaattccggtatggcctggtgcctggacagagaagactgggagggggctgcagtgggactcacctgaggagacagtgaccagggtgccacggccccagagatcgaagtaccgtcgacgttccgaattccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgttccgaattccggtactgagcgggctggcaaggc

SEQ ID NO: 2127 - DNA, 495 bp, Artificial Sequence
  Synthetic Template Oligonucleotide for IgH VJ Locus
gcctccctcgcgccatcaggttccgaagcaattcgtggcctggtgcctggacagagaagactgggagggggctgcagtgggactcacctgaggagacagtgaccagggtgccacggccccagagatcgaagtaccgtcgacgttccgaagcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgttccgaagcaattcgctgagcgggctggcaaggc

SEQ ID NO: 2128 - DNA, 495 bp, Artificial Sequence
  Synthetic Template Oligonucleotide for IgH VJ Locus
gcctccctcgcgccatcaggttccgaatgagcgaatggcctggtgcctggacagagaagactgggagggggctgcagtgggactcacctgaggagacagtgaccagggtgccacggccccagagatcgaagtaccgtcgacgttccgaatgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgttccgaatgagcgaactgagcgggctggcaaggc

SEQ ID NO: 2129 - DNA, 495 bp, Artificial Sequence
  Synthetic Template Oligonucleotide for IgH VJ Locus
gcctccctcgcgccatcaggttccgaatactaagctggcctggtgcctggacagagaagactgggagggggctgcagtgggactcacctgaggagacagtgaccagggtgccacggccccagagatcgaagtaccgtcgacgttccgaatactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgttccgaatactaagcctgagcgggctggcaaggc

SEQ ID NO: 2130 - DNA, 495 bp, Artificial Sequence
  Synthetic Template Oligonucleotide for IgH VJ Locus
gcctccctcgcgccatcaggttccgaatggcgtattggcctggtgcctggacagagaagactgggagggggctgcagtgggactcacctgaggagacagtgaccagggtgccacggccccagagatcgaagtaccgtcgacgttccgaatggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgttccgaatggcgtatctgagcgggctggcaaggc

SEQ ID NO: 2131 - DNA, 495 bp, Artificial Sequence
  Synthetic Template Oligonucleotide for IgH VJ Locus
gcctccctcgcgccatcaggttccgaagataaccatggcctggtgcctggacagagaagactgggagggggctgcagtgggactcacctgaggagacagtgaccagggtgccacggccccagagatcgaagtaccgtcgacgttccgaagataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggttccgaagataaccactgagcgggctggcaaggc

SEQ ID NO: 2132 - DNA, 495 bp, Artificial Sequence
  Synthetic Template Oligonucleotide for IgH VJ Locus
gcctccctcgcgccatcaggttccgaactagtgaatggcctggtgcctggacagagaagactgggagggggctgcagtgggactcacctgaggagacagtgaccagggtgccacggccccagagatcgaagtaccgtcgacgttccgaactagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggttccgaactagtgaactgagcgggctggcaaggc

SEQ ID NO: 2133 - DNA, 495 bp, Artificial Sequence
  Synthetic Template Oligonucleotide for IgH VJ Locus
gcctccctcgcgccatcaggttccgaaacgttcactggcctggtgcctggacagagaagactgggagggggctgcagtgggactcacctgaggagacagtgaccagggtgccacggccccagagatcgaagtaccgtcgacgttccgaaacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgttccgaaacgttcacctgagcgggctggcaaggc

SEQ ID NO: 2134 - DNA, 448 bp, Artificial Sequence
  Synthetic Template Oligonucleotide for IgH VJ Locus
gcctccctcgcgccatcaggttccgaaattacgcttggcctggtgcctggacagagaagactgggagggggctgcagtgggactcacctgaggagacagtgaccagggtgccacggccccagagatcgaagtaccgtcgacgttccgaaattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagttccgaaattacgctctgagcgggctggcaaggc

SEQ ID NO: 2135 - DNA, 495 bp, Artificial Sequence
  Synthetic Template Oligonucleotide for IgH VJ Locus
gcctccctcgcgccatcaggttccgaacattgagttggcctggtgcctggacagagaagactgggagggggctgcagtgggactcacctgaggagacagtgaccagggtgccacggccccagagatcgaagtaccgtcgacgttccgaacattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgttccgaacattgagtctgagcgggctggcaaggc

SEQ ID NO: 2136 - DNA, 495 bp, Artificial Sequence
  Synthetic Template Oligonucleotide for IgH VJ Locus
gcctccctcgcgccatcagcgttacttcttggttaccaggacagaggacgctgggcccagagaaaggaggcagaaggaaagccatcttacctgaagagacggtgaccattgtcccttggccccagatatcaaaaggtcgaccgttacttcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcccgttacttcttggttactgagcgggctggcaaggc

SEQ ID NO: 2137 - DNA, 495 bp, Artificial Sequence
  Synthetic Template Oligonucleotide for IgH VJ Locus
gcctccctcgcgccatcagcgttacttacctcttgccaggacagaggacgctgggcccagagaaaggaggcagaaggaaagccatcttacctgaagagacggtgaccattgtcccttggccccagatatcaaaaggtcgaccgttacttacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacccgttacttacctcttgctgagcgggctggcaaggc

SEQ ID NO: 2138 - DNA, 495 bp, Artificial Sequence
  Synthetic Template Oligonucleotide for IgH VJ Locus
gcctccctcgcgccatcagcgttacttctgattctccaggacagaggacgctgggcccagagaaaggaggcagaaggaaagccatcttacctgaagagacggtgaccattgtcccttggccccagatatcaaaaggtcgaccgttacttctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcacccgttacttctgattctctgagcgggctggcaaggc

SEQ ID NO: 2139 - DNA, 495 bp, Artificial Sequence
  Synthetic Template Oligonucleotide for IgH VJ Locus
gcctccctcgcgccatcagcgttacttagtaccgaccaggacagaggacgctgggcccagagaaaggaggcagaaggaaagccatcttacctgaagagacggtgaccattgtcccttggccccagatatcaaaaggtcgaccgttacttagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcacccgttacttagtaccgactgagcgggctggcaaggc

SEQ ID NO: 2140 - DNA, 495 bp, Artificial Sequence
  Synthetic Template Oligonucleotide for IgH VJ Locus
gcctccctcgcgccatcagcgttacttatccatggccaggacagaggacgctgggcccagagaaaggaggcagaaggaaagccatcttacctgaagagacggtgaccattgtcccttggccccagatatcaaaaggtcgaccgttacttatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgcccgttacttatccatggctgagcgggctggcaaggc

SEQ ID NO: 2141 - DNA, 495 bp, Artificial Sequence
  Synthetic Template Oligonucleotide for IgH VJ Locus
gcctccctcgcgccatcagcgttacttgtagcagtccaggacagaggacgctgggcccagagaaaggaggcagaaggaaagccatcttacctgaagagacggtgaccattgtcccttggccccagatatcaaaaggtcgaccgttacttgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatccgttacttgtagcagtctgagcgggctggcaaggc

SEQ ID NO: 2142 - DNA, 495 bp, Artificial Sequence
  Synthetic Template Oligonucleotide for IgH VJ Locus
gcctccctcgcgccatcagcgttacttatcttcgtccaggacagaggacgctgggcccagagaaaggaggcagaaggaaagccatcttacctgaagagacggtgaccattgtcccttggccccagatatcaaaaggtcgaccgttacttatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacccgttacttatcttcgtctgagcgggctggcaaggc

SEQ ID NO: 2143 - DNA, 495 bp, Artificial Sequence
  Synthetic Template Oligonucleotide for IgH VJ Locus
gcctccctcgcgccatcagcgttactttccacagtccaggacagaggacgctgggcccagagaaaggaggcagaaggaaagccatcttacctgaagagacggtgaccattgtcccttggccccagatatcaaaaggtcgaccgttactttccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcacccgttactttccacagtctgagcgggctggcaaggc

SEQ ID NO: 2144 - DNA, 495 bp, Artificial Sequence
  Synthetic Template Oligonucleotide for IgH VJ Locus
gcctccctcgcgccatcagcgttacttagctagtgccaggacagaggacgctgggcccagagaaaggaggcagaaggaaagccatcttacctgaagagacggtgaccattgtcccttggccccagatatcaaaaggtcgaccgttacttagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacacccgttacttagctagtgctgagcgggctggcaaggc

SEQ ID NO: 2145 - DNA, 495 bp, Artificial Sequence
  Synthetic Template Oligonucleotide for IgH VJ Locus
gcctccctcgcgccatcagcgttactttaaccaagccaggacagaggacgctgggcccagagaaaggaggcagaaggaaagccatcttacctgaagagacggtgaccattgtcccttggccccagatatcaaaaggtcgaccgttactttaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcacccgttactttaaccaagctgagcgggctggcaaggc

SEQ ID NO: 2146 - DNA, 495 bp, Artificial Sequence
  Synthetic Template Oligonucleotide for IgH VJ Locus
gcctccctcgcgccatcagcgttacttcaagaggtccaggacagaggacgctgggcccagagaaaggaggcagaaggaaagccatcttacctgaagagacggtgaccattgtcccttggccccagatatcaaaaggtcgaccgttacttcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgcccgttacttcaagaggtctgagcgggctggcaaggc

SEQ ID NO: 2147 - DNA, 495 bp, Artificial Sequence
  Synthetic Template Oligonucleotide for IgH VJ Locus
gcctccctcgcgccatcagcgttacttagttgaccccaggacagaggacgctgggcccagagaaaggaggcagaaggaaagccatcttacctgaagagacggtgaccattgtcccttggccccagatatcaaaaggtcgaccgttacttagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaacgttacttagttgaccctgagcgggctggcaaggc

SEQ ID NO: 2148 - DNA, 495 bp, Artificial Sequence
  Synthetic Template Oligonucleotide for IgH VJ Locus
gcctccctcgcgccatcagcgttacttcagcatatccaggacagaggacgctgggcccagagaaaggaggcagaaggaaagccatcttacctgaagagacggtgaccattgtcccttggccccagatatcaaaaggtcgaccgttacttcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaacgttacttcagcatatctgagcgggctggcaaggc

SEQ ID NO: 2149 - DNA, 495 bp, Artificial Sequence
  Synthetic Template Oligonucleotide for IgH VJ Locus
gcctccctcgcgccatcagcgttacttgcaggattccaggacagaggacgctgggcccagagaaaggaggcagaaggaaagccatcttacctgaagagacggtgaccattgtcccttggccccagatatcaaaaggtcgaccgttacttgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataacgttacttgcaggattctgagcgggctggcaaggc

SEQ ID NO: 2150 - DNA, 495 bp, Artificial Sequence
  Synthetic Template Oligonucleotide for IgH VJ Locus
gcctccctcgcgccatcagcgttacttgtccattcccaggacagaggacgctgggcccagagaaaggaggcagaaggaaagccatcttacctgaagagacggtgaccattgtcccttggccccagatatcaaaaggtcgaccgttacttgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacccgttacttgtccattcctgagcgggctggcaaggc

SEQ ID NO: 2151 - DNA, 495 bp, Artificial Sequence
  Synthetic Template Oligonucleotide for IgH VJ Locus
gcctccctcgcgccatcagcgttacttgcataactccaggacagaggacgctgggcccagagaaaggaggcagaaggaaagccatcttacctgaagagacggtgaccattgtcccttggccccagatatcaaaaggtcgaccgttacttgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggaccgttacttgcataactctgagcgggctggcaaggc

SEQ ID NO: 2152 - DNA, 495 bp, Artificial Sequence
  Synthetic Template Oligonucleotide for IgH VJ Locus
gcctccctcgcgccatcagcgttacttatatgctgccaggacagaggacgctgggcccagagaaaggaggcagaaggaaagccatcttacctgaagagacggtgaccattgtcccttggccccagatatcaaaaggtcgaccgttacttatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacacccgttacttatatgctgctgagcgggctggcaaggc

SEQ ID NO: 2153 - DNA, 495 bp, Artificial Sequence
  Synthetic Template Oligonucleotide for IgH VJ Locus
gcctccctcgcgccatcagcgttacttaatcctgcccaggacagaggacgctgggcccagagaaaggaggcagaaggaaagccatcttacctgaagagacggtgaccattgtcccttggccccagatatcaaaaggtcgaccgttacttaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgccgttacttaatcctgcctgagcgggctggcaaggc

SEQ ID NO: 2154 - DNA, 495 bp, Artificial Sequence
  Synthetic Template Oligonucleotide for IgH VJ Locus
gcctccctcgcgccatcagcgttactttgagacctccaggacagaggacgctgggcccagagaaaggaggcagaaggaaagccatcttacctgaagagacggtgaccattgtcccttggccccagatatcaaaaggtcgaccgttactttgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgcgttactttgagacctctgagcgggctggcaaggc

SEQ ID NO: 2155 - DNA, 495 bp, Artificial Sequence
  Synthetic Template Oligonucleotide for IgH VJ Locus
gcctccctcgcgccatcagcgttacttgaatggacccaggacagaggacgctgggcccagagaaaggaggcagaaggaaagccatcttacctgaagagacggtgaccattgtcccttggccccagatatcaaaaggtcgaccgttacttgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacacccgttacttgaatggacctgagcgggctggcaaggc

SEQ ID NO: 2156 - DNA, 495 bp, Artificial Sequence
  Synthetic Template Oligonucleotide for IgH VJ Locus
gcctccctcgcgccatcagcgttacttcacatggaccaggacagaggacgctgggcccagagaaaggaggcagaaggaaagccatcttacctgaagagacggtgaccattgtcccttggccccagatatcaaaaggtcgaccgttacttcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacacccgttacttcacatggactgagcgggctggcaaggc

SEQ ID NO: 2157 - DNA, 495 bp, Artificial Sequence
  Synthetic Template Oligonucleotide for IgH VJ Locus
gcctccctcgcgccatcagcgttacttttgaccatccaggacagaggacgctgggcccagagaaaggaggcagaaggaaagccatcttacctgaagagacggtgaccattgtcccttggccccagatatcaaaaggtcgaccgttacttttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacacccgttacttttgaccatctgagcgggctggcaaggc

SEQ ID NO: 2158 - DNA, 495 bp, Artificial Sequence
  Synthetic Template Oligonucleotide for IgH VJ Locus
gcctccctcgcgccatcagcgttacttaagccatcccaggacagaggacgctgggcccagagaaaggaggcagaaggaaagccatcttacctgaagagacggtgaccattgtcccttggccccagatatcaaaaggtcgaccgttacttaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacacccgttacttaagccatcctgagcgggctggcaaggc

SEQ ID NO: 2159 - DNA, 495 bp, Artificial Sequence
  Synthetic Template Oligonucleotide for IgH VJ Locus
gcctccctcgcgccatcagcgttactttccatgtgccaggacagaggacgctgggcccagagaaaggaggcagaaggaaagccatcttacctgaagagacggtgaccattgtcccttggccccagatatcaaaaggtcgaccgttactttccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacccgttactttccatgtgctgagcgggctggcaaggc

SEQ ID NO: 2160 - DNA, 495 bp, Artificial Sequence
  Synthetic Template Oligonucleotide for IgH VJ Locus
gcctccctcgcgccatcagcgttacttcaagtcacccaggacagaggacgctgggcccagagaaaggaggcagaaggaaagccatcttacctgaagagacggtgaccattgtcccttggccccagatatcaaaaggtcgaccgttacttcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacccgttacttcaagtcacctgagcgggctggcaaggc

SEQ ID NO: 2161 - DNA, 495 bp, Artificial Sequence
  Synthetic Template Oligonucleotide for IgH VJ Locus
gcctccctcgcgccatcagcgttacttctgcaatcccaggacagaggacgctgggcccagagaaaggaggcagaaggaaagccatcttacctgaagagacggtgaccattgtcccttggccccagatatcaaaaggtcgaccgttacttctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacacccgttacttctgcaatcctgagcgggctggcaaggc

SEQ ID NO: 2162 - DNA, 495 bp, Artificial Sequence
  Synthetic Template Oligonucleotide for IgH VJ Locus
gcctccctcgcgccatcagcgttacttatcgacgaccaggacagaggacgctgggcccagagaaaggaggcagaaggaaagccatcttacctgaagagacggtgaccattgtcccttggccccagatatcaaaaggtcgaccgttacttatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacacccgttacttatcgacgactgagcgggctggcaaggc

SEQ ID NO: 2163 - DNA, 495 bp, Artificial Sequence
  Synthetic Template Oligonucleotide for IgH VJ Locus
gcctccctcgcgccatcagcgttacttacagactgccaggacagaggacgctgggcccagagaaaggaggcagaaggaaagccatcttacctgaagagacggtgaccattgtcccttggccccagatatcaaaaggtcgaccgttacttacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaacgttacttacagactgctgagcgggctggcaaggc

SEQ ID NO: 2164 - DNA, 495 bp, Artificial Sequence
  Synthetic Template Oligonucleotide for IgH VJ Locus
gcctccctcgcgccatcagcgttacttccttatagccaggacagaggacgctgggcccagagaaaggaggcagaaggaaagccatcttacctgaagagacggtgaccattgtcccttggccccagatatcaaaaggtcgaccgttacttccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggaccgttacttccttatagctgagcgggctggcaaggc

SEQ ID NO: 2165 - DNA, 495 bp, Artificial Sequence
  Synthetic Template Oligonucleotide for IgH VJ Locus
gcctccctcgcgccatcagcgttactttacgcgttccaggacagaggacgctgggcccagagaaaggaggcagaaggaaagccatcttacctgaagagacggtgaccattgtcccttggccccagatatcaaaaggtcgaccgttactttacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacacccgttactttacgcgttctgagcgggctggcaaggc

SEQ ID NO: 2166 - DNA, 495 bp, Artificial Sequence
  Synthetic Template Oligonucleotide for IgH VJ Locus
gcctccctcgcgccatcagcgttacttctataaggccaggacagaggacgctgggcccagagaaaggaggcagaaggaaagccatcttacctgaagagacggtgaccattgtcccttggccccagatatcaaaaggtcgaccgttacttctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgcgttacttctataaggctgagcgggctggcaaggc

SEQ ID NO: 2167 - DNA, 495 bp, Artificial Sequence
  Synthetic Template Oligonucleotide for IgH VJ Locus
gcctccctcgcgccatcagcgttactttcttagtcccaggacagaggacgctgggcccagagaaaggaggcagaaggaaagccatcttacctgaagagacggtgaccattgtcccttggccccagatatcaaaaggtcgaccgttactttcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgccgttactttcttagtcctgagcgggctggcaaggc

SEQ ID NO: 2168 - DNA, 495 bp, Artificial Sequence
  Synthetic Template Oligonucleotide for IgH VJ Locus
gcctccctcgcgccatcagcgttactttgtctgcaccaggacagaggacgctgggcccagagaaaggaggcagaaggaaagccatcttacctgaagagacggtgaccattgtcccttggccccagatatcaaaaggtcgaccgttactttgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacacccgttactttgtctgcactgagcgggctggcaaggc

SEQ ID NO: 2169 - DNA, 495 bp, Artificial Sequence
  Synthetic Template Oligonucleotide for IgH VJ Locus
gcctccctcgcgccatcagcgttacttgccattaaccaggacagaggacgctgggcccagagaaaggaggcagaaggaaagccatcttacctgaagagacggtgaccattgtcccttggccccagatatcaaaaggtcgaccgttacttgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgccgttacttgccattaactgagcgggctggcaaggc

SEQ ID NO: 2170 - DNA, 495 bp, Artificial Sequence
  Synthetic Template Oligonucleotide for IgH VJ Locus
gcctccctcgcgccatcagcgttacttgactaagaccaggacagaggacgctgggcccagagaaaggaggcagaaggaaagccatcttacctgaagagacggtgaccattgtcccttggccccagatatcaaaaggtcgaccgttacttgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgcgttacttgactaagactgagcgggctggcaaggc

SEQ ID NO: 2171 - DNA, 495 bp, Artificial Sequence
  Synthetic Template Oligonucleotide for IgH VJ Locus
gcctccctcgcgccatcagcgttacttaggttgctccaggacagaggacgctgggcccagagaaaggaggcagaaggaaagccatcttacctgaagagacggtgaccattgtcccttggccccagatatcaaaaggtcgaccgttacttaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgcgttacttaggttgctctgagcgggctggcaaggc

SEQ ID NO: 2172 - DNA, 495 bp, Artificial Sequence
  Synthetic Template Oligonucleotide for IgH VJ Locus
gcctccctcgcgccatcagcgttacttctcgagaaccaggacagaggacgctgggcccagagaaaggaggcagaaggaaagccatcttacctgaagagacggtgaccattgtcccttggccccagatatcaaaaggtcgaccgttacttctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacacccgttacttctcgagaactgagcgggctggcaaggc

SEQ ID NO: 2173 - DNA, 495 bp, Artificial Sequence
  Synthetic Template Oligonucleotide for IgH VJ Locus
gcctccctcgcgccatcagcgttacttttaatggcccaggacagaggacgctgggcccagagaaaggaggcagaaggaaagccatcttacctgaagagacggtgaccattgtcccttggccccagatatcaaaaggtcgaccgttacttttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacacccgttacttttaatggcctgagcgggctggcaaggc

SEQ ID NO: 2174 - DNA, 495 bp, Artificial Sequence
  Synthetic Template Oligonucleotide for IgH VJ Locus
gcctccctcgcgccatcagcgttactttgcagacaccaggacagaggacgctgggcccagagaaaggaggcagaaggaaagccatcttacctgaagagacggtgaccattgtcccttggccccagatatcaaaaggtcgaccgttactttgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaacgttactttgcagacactgagcgggctggcaaggc

SEQ ID NO: 2175 - DNA, 495 bp, Artificial Sequence
  Synthetic Template Oligonucleotide for IgH VJ Locus
gcctccctcgcgccatcagcgttactttcactgagccaggacagaggacgctgggcccagagaaaggaggcagaaggaaagccatcttacctgaagagacggtgaccattgtcccttggccccagatatcaaaaggtcgaccgttactttcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtcgttactttcactgagctgagcgggctggcaaggc

SEQ ID NO: 2176 - DNA, 495 bp, Artificial Sequence
  Synthetic Template Oligonucleotide for IgH VJ Locus
gcctccctcgcgccatcagcgttacttgagtacgtccaggacagaggacgctgggcccagagaaaggaggcagaaggaaagccatcttacctgaagagacggtgaccattgtcccttggccccagatatcaaaaggtcgaccgttacttgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccaccgttacttgagtacgtctgagcgggctggcaaggc

SEQ ID NO: 2177 - DNA, 495 bp, Artificial Sequence
  Synthetic Template Oligonucleotide for IgH VJ Locus
gcctccctcgcgccatcagcgttacttatacgccaccaggacagaggacgctgggcccagagaaaggaggcagaaggaaagccatcttacctgaagagacggtgaccattgtcccttggccccagatatcaaaaggtcgaccgttacttatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggaccgttacttatacgccactgagcgggctggcaaggc

SEQ ID NO: 2178 - DNA, 495 bp, Artificial Sequence
  Synthetic Template Oligonucleotide for IgH VJ Locus
gcctccctcgcgccatcagcgttactttcgcatcaccaggacagaggacgctgggcccagagaaaggaggcagaaggaaagccatcttacctgaagagacggtgaccattgtcccttggccccagatatcaaaaggtcgaccgttactttcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggaccgttactttcgcatcactgagcgggctggcaaggc

SEQ ID NO: 2179 - DNA, 495 bp, Artificial Sequence
  Synthetic Template Oligonucleotide for IgH VJ Locus
gcctccctcgcgccatcagcgttacttcgcttaatccaggacagaggacgctgggcccagagaaaggaggcagaaggaaagccatcttacctgaagagacggtgaccattgtcccttggccccagatatcaaaaggtcgaccgttacttcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggaccgttacttcgcttaatctgagcgggctggcaaggc

SEQ ID NO: 2180 - DNA, 495 bp, Artificial Sequence
  Synthetic Template Oligonucleotide for IgH VJ Locus
gcctccctcgcgccatcagcgttactttggttatcccaggacagaggacgctgggcccagagaaaggaggcagaaggaaagccatcttacctgaagagacggtgaccattgtcccttggccccagatatcaaaaggtcgaccgttactttggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtcgttactttggttatcctgagcgggctggcaaggc

SEQ ID NO: 2181 - DNA, 495 bp, Artificial Sequence
  Synthetic Template Oligonucleotide for IgH VJ Locus
gcctccctcgcgccatcagcgttacttggattgctccaggacagaggacgctgggcccagagaaaggaggcagaaggaaagccatcttacctgaagagacggtgaccattgtcccttggccccagatatcaaaaggtcgaccgttacttggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggaccgttacttggattgctctgagcgggctggcaaggc

SEQ ID NO: 2182 - DNA, 495 bp, Artificial Sequence
  Synthetic Template Oligonucleotide for IgH VJ Locus
gcctccctcgcgccatcagcgttacttctcagtgaccaggacagaggacgctgggcccagagaaaggaggcagaaggaaagccatcttacctgaagagacggtgaccattgtcccttggccccagatatcaaaaggtcgaccgttacttctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtcgttacttctcagtgactgagcgggctggcaaggc

SEQ ID NO: 2183 - DNA, 495 bp, Artificial Sequence
  Synthetic Template Oligonucleotide for IgH VJ Locus
gcctccctcgcgccatcagcgttacttacgtactcccaggacagaggacgctgggcccagagaaaggaggcagaaggaaagccatcttacctgaagagacggtgaccattgtcccttggccccagatatcaaaaggtcgaccgttacttacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggaccgttacttacgtactcctgagcgggctggcaaggc

SEQ ID NO: 2184 - DNA, 495 bp, Artificial Sequence
  Synthetic Template Oligonucleotide for IgH VJ Locus
gcctccctcgcgccatcagcgttactttgatgcgaccaggacagaggacgctgggcccagagaaaggaggcagaaggaaagccatcttacctgaagagacggtgaccattgtcccttggccccagatatcaaaaggtcgaccgttactttgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggacccccgttactttgatgcgactgagcgggctggcaaggc

SEQ ID NO: 2185 - DNA, 495 bp, Artificial Sequence
  Synthetic Template Oligonucleotide for IgH VJ Locus
gcctccctcgcgccatcagcgttacttattaagcgccaggacagaggacgctgggcccagagaaaggaggcagaaggaaagccatcttacctgaagagacggtgaccattgtcccttggccccagatatcaaaaggtcgaccgttacttattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactcccgttacttattaagcgctgagcgggctggcaaggc

SEQ ID NO: 2186 - DNA, 495 bp, Artificial Sequence
  Synthetic Template Oligonucleotide for IgH VJ Locus
gcctccctcgcgccatcagcgttacttagcaatccccaggacagaggacgctgggcccagagaaaggaggcagaaggaaagccatcttacctgaagagacggtgaccattgtcccttggccccagatatcaaaaggtcgaccgttacttagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactcccgttacttagcaatccctgagcgggctggcaaggc

SEQ ID NO: 2187 - DNA, 495 bp, Artificial Sequence
  Synthetic Template Oligonucleotide for IgH VJ Locus
gcctccctcgcgccatcagcgttacttgcttagtaccaggacagaggacgctgggcccagagaaaggaggcagaaggaaagccatcttacctgaagagacggtgaccattgtcccttggccccagatatcaaaaggtcgaccgttacttgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgacgttacttgcttagtactgagcgggctggcaaggc

SEQ ID NO: 2188 - DNA, 495 bp, Artificial Sequence
  Synthetic Template Oligonucleotide for IgH VJ Locus
gcctccctcgcgccatcagcgttactttgaccttgccaggacagaggacgctgggcccagagaaaggaggcagaaggaaagccatcttacctgaagagacggtgaccattgtcccttggccccagatatcaaaaggtcgaccgttactttgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcacccgttactttgaccttgctgagcgggctggcaaggc

SEQ ID NO: 2189 - DNA, 495 bp, Artificial Sequence
  Synthetic Template Oligonucleotide for IgH VJ Locus
gcctccctcgcgccatcagcgttacttcaaggtcaccaggacagaggacgctgggcccagagaaaggaggcagaaggaaagccatcttacctgaagagacggtgaccattgtcccttggccccagatatcaaaaggtcgaccgttacttcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtacccgttacttcaaggtcactgagcgggctggcaaggc

SEQ ID NO: 2190 - DNA, 495 bp, Artificial Sequence
  Synthetic Template Oligonucleotide for IgH VJ Locus
gcctccctcgcgccatcagcgttacttcactgtacccaggacagaggacgctgggcccagagaaaggaggcagaaggaaagccatcttacctgaagagacggtgaccattgtcccttggccccagatatcaaaaggtcgaccgttacttcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttccgttacttcactgtacctgagcgggctggcaaggc

SEQ ID NO: 2191 - DNA, 495 bp, Artificial Sequence
  Synthetic Template Oligonucleotide for IgH VJ Locus
gcctccctcgcgccatcagcgttacttgatgatccccaggacagaggacgctgggcccagagaaaggaggcagaaggaaagccatcttacctgaagagacggtgaccattgtcccttggccccagatatcaaaaggtcgaccgttacttgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggcgttacttgatgatccctgagcgggctggcaaggc

SEQ ID NO: 2192 - DNA, 495 bp, Artificial Sequence
  Synthetic Template Oligonucleotide for IgH VJ Locus
gcctccctcgcgccatcagcgttacttcgccaataccaggacagaggacgctgggcccagagaaaggaggcagaaggaaagccatcttacctgaagagacggtgaccattgtcccttggccccagatatcaaaaggtcgaccgttacttcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggcgttacttcgccaatactgagcgggctggcaaggc

SEQ ID NO: 2193 - DNA, 495 bp, Artificial Sequence
  Synthetic Template Oligonucleotide for IgH VJ Locus
gcctccctcgcgccatcagcgttactttcaagcctccaggacagaggacgctgggcccagagaaaggaggcagaaggaaagccatcttacctgaagagacggtgaccattgtcccttggccccagatatcaaaaggtcgaccgttactttcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacacgttactttcaagcctctgagcgggctggcaaggc

SEQ ID NO: 2194 - DNA, 495 bp, Artificial Sequence
  Synthetic Template Oligonucleotide for IgH VJ Locus
gcctccctcgcgccatcagcgttacttacgtgtgtccaggacagaggacgctgggcccagagaaaggaggcagaaggaaagccatcttacctgaagagacggtgaccattgtcccttggccccagatatcaaaaggtcgaccgttacttacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagcgttacttacgtgtgtctgagcgggctggcaaggc

SEQ ID NO: 2195 - DNA, 495 bp, Artificial Sequence
  Synthetic Template Oligonucleotide for IgH VJ Locus
gcctccctcgcgccatcagcgttactttccgtctaccaggacagaggacgctgggcccagagaaaggaggcagaaggaaagccatcttacctgaagagacggtgaccattgtcccttggccccagatatcaaaaggtcgaccgttactttccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagcgttactttccgtctactgagcgggctggcaaggc

SEQ ID NO: 2196 - DNA, 495 bp, Artificial Sequence
  Synthetic Template Oligonucleotide for IgH VJ Locus
gcctccctcgcgccatcagcgttacttaagagctgccaggacagaggacgctgggcccagagaaaggaggcagaaggaaagccatcttacctgaagagacggtgaccattgtcccttggccccagatatcaaaaggtcgaccgttacttaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgcgttacttaagagctgctgagcgggctggcaaggc

SEQ ID NO: 2197 - DNA, 495 bp, Artificial Sequence
  Synthetic Template Oligonucleotide for IgH VJ Locus
gcctccctcgcgccatcagcgttactttatcgctcccaggacagaggacgctgggcccagagaaaggaggcagaaggaaagccatcttacctgaagagacggtgaccattgtcccttggccccagatatcaaaaggtcgaccgttactttatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagcgttactttatcgctcctgagcgggctggcaaggc

SEQ ID NO: 2198 - DNA, 495 bp, Artificial Sequence
  Synthetic Template Oligonucleotide for IgH VJ Locus
gcctccctcgcgccatcagcgttactttcagatgcccaggacagaggacgctgggcccagagaaaggaggcagaaggaaagccatcttacctgaagagacggtgaccattgtcccttggccccagatatcaaaaggtcgaccgttactttcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaaccccgttactttcagatgcctgagcgggctggcaaggc

SEQ ID NO: 2199 - DNA, 495 bp, Artificial Sequence
  Synthetic Template Oligonucleotide for IgH VJ Locus
gcctccctcgcgccatcagcgttacttgtgtagcaccaggacagaggacgctgggcccagagaaaggaggcagaaggaaagccatcttacctgaagagacggtgaccattgtcccttggccccagatatcaaaaggtcgaccgttacttgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgcgttacttgtgtagcactgagcgggctggcaaggc

SEQ ID NO: 2200 - DNA, 495 bp, Artificial Sequence
  Synthetic Template Oligonucleotide for IgH VJ Locus
gcctccctcgcgccatcagcgttactttggcagttccaggacagaggacgctgggcccagagaaaggaggcagaaggaaagccatcttacctgaagagacggtgaccattgtcccttggccccagatatcaaaaggtcgaccgttactttggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgcgttactttggcagttctgagcgggctggcaaggc

SEQ ID NO: 2201 - DNA, 495 bp, Artificial Sequence
  Synthetic Template Oligonucleotide for IgH VJ Locus
gcctccctcgcgccatcagcgttacttcagtccaaccaggacagaggacgctgggcccagagaaaggaggcagaaggaaagccatcttacctgaagagacggtgaccattgtcccttggccccagatatcaaaaggtcgaccgttacttcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcaccgttacttcagtccaactgagcgggctggcaaggc

SEQ ID NO: 2202 - DNA, 495 bp, Artificial Sequence
  Synthetic Template Oligonucleotide for IgH VJ Locus
gcctccctcgcgccatcagcgttacttgtgtctacccaggacagaggacgctgggcccagagaaaggaggcagaaggaaagccatcttacctgaagagacggtgaccattgtcccttggccccagatatcaaaaggtcgaccgttacttgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggcgttacttgtgtctacctgagcgggctggcaaggc

SEQ ID NO: 2203 - DNA, 495 bp, Artificial Sequence
  Synthetic Template Oligonucleotide for IgH VJ Locus
gcctccctcgcgccatcagcgttacttgtacagtgccaggacagaggacgctgggcccagagaaaggaggcagaaggaaagccatcttacctgaagagacggtgaccattgtcccttggccccagatatcaaaaggtcgaccgttacttgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagcgttacttgtacagtgctgagcgggctggcaaggc

SEQ ID NO: 2204 - DNA, 495 bp, Artificial Sequence
  Synthetic Template Oligonucleotide for IgH VJ Locus
gcctccctcgcgccatcagcgttacttggatcatcccaggacagaggacgctgggcccagagaaaggaggcagaaggaaagccatcttacctgaagagacggtgaccattgtcccttggccccagatatcaaaaggtcgaccgttacttggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagcgttacttggatcatcctgagcgggctggcaaggc

SEQ ID NO: 2205 - DNA, 495 bp, Artificial Sequence
  Synthetic Template Oligonucleotide for IgH VJ Locus
gcctccctcgcgccatcagcgttactttattggcgccaggacagaggacgctgggcccagagaaaggaggcagaaggaaagccatcttacctgaagagacggtgaccattgtcccttggccccagatatcaaaaggtcgaccgttactttattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcacgttactttattggcgctgagcgggctggcaaggc

SEQ ID NO: 2206 - DNA, 495 bp, Artificial Sequence
  Synthetic Template Oligonucleotide for IgH VJ Locus
gcctccctcgcgccatcagcgttacttaggcttgaccaggacagaggacgctgggcccagagaaaggaggcagaaggaaagccatcttacctgaagagacggtgaccattgtcccttggccccagatatcaaaaggtcgaccgttacttaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcaccgttacttaggcttgactgagcgggctggcaaggc

SEQ ID NO: 2207 - DNA, 495 bp, Artificial Sequence
  Synthetic Template Oligonucleotide for IgH VJ Locus
gcctccctcgcgccatcagcgttacttacacacgtccaggacagaggacgctgggcccagagaaaggaggcagaaggaaagccatcttacctgaagagacggtgaccattgtcccttggccccagatatcaaaaggtcgaccgttacttacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatcgttacttacacacgtctgagcgggctggcaaggc

SEQ ID NO: 2208 - DNA, 495 bp, Artificial Sequence
  Synthetic Template Oligonucleotide for IgH VJ Locus
gcctccctcgcgccatcagcgttactttagacggaccaggacagaggacgctgggcccagagaaaggaggcagaaggaaagccatcttacctgaagagacggtgaccattgtcccttggccccagatatcaaaaggtcgaccgttactttagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgacgttactttagacggactgagcgggctggcaaggc

SEQ ID NO: 2209 - DNA, 495 bp, Artificial Sequence
  Synthetic Template Oligonucleotide for IgH VJ Locus
gcctccctcgcgccatcagcgttacttgagcgataccaggacagaggacgctgggcccagagaaaggaggcagaaggaaagccatcttacctgaagagacggtgaccattgtcccttggccccagatatcaaaaggtcgaccgttacttgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttcgttacttgagcgatactgagcgggctggcaaggc

SEQ ID NO: 2210 - DNA, 495 bp, Artificial Sequence
  Synthetic Template Oligonucleotide for IgH VJ Locus
gcctccctcgcgccatcagcgttacttgcatctgaccaggacagaggacgctgggcccagagaaaggaggcagaaggaaagccatcttacctgaagagacggtgaccattgtcccttggccccagatatcaaaaggtcgaccgttacttgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacacgttacttgcatctgactgagcgggctggcaaggc

SEQ ID NO: 2211 - DNA, 495 bp, Artificial Sequence
  Synthetic Template Oligonucleotide for IgH VJ Locus
gcctccctcgcgccatcagcgttactttgctacacccaggacagaggacgctgggcccagagaaaggaggcagaaggaaagccatcttacctgaagagacggtgaccattgtcccttggccccagatatcaaaaggtcgaccgttactttgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgcgttactttgctacacctgagcgggctggcaaggc

SEQ ID NO: 2212 - DNA, 495 bp, Artificial Sequence
  Synthetic Template Oligonucleotide for IgH VJ Locus
gcctccctcgcgccatcagcgttacttaactgccaccaggacagaggacgctgggcccagagaaaggaggcagaaggaaagccatcttacctgaagagacggtgaccattgtcccttggccccagatatcaaaaggtcgaccgttacttaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttcgttacttaactgccactgagcgggctggcaaggc

SEQ ID NO: 2213 - DNA, 495 bp, Artificial Sequence
  Synthetic Template Oligonucleotide for IgH VJ Locus
gcctccctcgcgccatcagcgttacttttggactgccaggacagaggacgctgggcccagagaaaggaggcagaaggaaagccatcttacctgaagagacggtgaccattgtcccttggccccagatatcaaaaggtcgaccgttacttttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggcgttacttttggactgctgagcgggctggcaaggc

SEQ ID NO: 2214 - DNA, 495 bp, Artificial Sequence
  Synthetic Template Oligonucleotide for IgH VJ Locus
gcctccctcgcgccatcagcgttactttcggtactccaggacagaggacgctgggcccagagaaaggaggcagaaggaaagccatcttacctgaagagacggtgaccattgtcccttggccccagatatcaaaaggtcgaccgttactttcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgcgttactttcggtactctgagcgggctggcaaggc

SEQ ID NO: 2215 - DNA, 495 bp, Artificial Sequence
  Synthetic Template Oligonucleotide for IgH VJ Locus
gcctccctcgcgccatcagcgttacttccatggatccaggacagaggacgctgggcccagagaaaggaggcagaaggaaagccatcttacctgaagagacggtgaccattgtcccttggccccagatatcaaaaggtcgaccgttacttccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggataccgttacttccatggatctgagcgggctggcaaggc

SEQ ID NO: 2216 - DNA, 495 bp, Artificial Sequence
  Synthetic Template Oligonucleotide for IgH VJ Locus
gcctccctcgcgccatcagcgttacttacgaagatccaggacagaggacgctgggcccagagaaaggaggcagaaggaaagccatcttacctgaagagacggtgaccattgtcccttggccccagatatcaaaaggtcgaccgttacttacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaacgttacttacgaagatctgagcgggctggcaaggc

SEQ ID NO: 2217 - DNA, 495 bp, Artificial Sequence
  Synthetic Template Oligonucleotide for IgH VJ Locus
gcctccctcgcgccatcagcgttacttactgtggaccaggacagaggacgctgggcccagagaaaggaggcagaaggaaagccatcttacctgaagagacggtgaccattgtcccttggccccagatatcaaaaggtcgaccgttacttactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttcgttacttactgtggactgagcgggctggcaaggc

SEQ ID NO: 2218 - DNA, 495 bp, Artificial Sequence
  Synthetic Template Oligonucleotide for IgH VJ Locus
gcctccctcgcgccatcagcgttacttggtgtcatccaggacagaggacgctgggcccagagaaaggaggcagaaggaaagccatcttacctgaagagacggtgaccattgtcccttggccccagatatcaaaaggtcgaccgttacttggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctcgttacttggtgtcatctgagcgggctggcaaggc

SEQ ID NO: 2219 - DNA, 495 bp, Artificial Sequence
  Synthetic Template Oligonucleotide for IgH VJ Locus
gcctccctcgcgccatcagcgttactttcgtgaagccaggacagaggacgctgggcccagagaaaggaggcagaaggaaagccatcttacctgaagagacggtgaccattgtcccttggccccagatatcaaaaggtcgaccgttactttcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggcgttactttcgtgaagctgagcgggctggcaaggc

SEQ ID NO: 2220 - DNA, 495 bp, Artificial Sequence
  Synthetic Template Oligonucleotide for IgH VJ Locus
gcctccctcgcgccatcagcgttacttcactagctccaggacagaggacgctgggcccagagaaaggaggcagaaggaaagccatcttacctgaagagacggtgaccattgtcccttggccccagatatcaaaaggtcgaccgttacttcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaacgttacttcactagctctgagcgggctggcaaggc

SEQ ID NO: 2221 - DNA, 495 bp, Artificial Sequence
  Synthetic Template Oligonucleotide for IgH VJ Locus
gcctccctcgcgccatcagcgttacttggtcaactccaggacagaggacgctgggcccagagaaaggaggcagaaggaaagccatcttacctgaagagacggtgaccattgtcccttggccccagatatcaaaaggtcgaccgttacttggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggacgttacttggtcaactctgagcgggctggcaaggc

SEQ ID NO: 2222 - DNA, 495 bp, Artificial Sequence
  Synthetic Template Oligonucleotide for IgH VJ Locus
gcctccctcgcgccatcagcgttactttacgtacgccaggacagaggacgctgggcccagagaaaggaggcagaaggaaagccatcttacctgaagagacggtgaccattgtcccttggccccagatatcaaaaggtcgaccgttactttacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatccgttactttacgtacgctgagcgggctggcaaggc

SEQ ID NO: 2223 - DNA, 495 bp, Artificial Sequence
  Synthetic Template Oligonucleotide for IgH VJ Locus
gcctccctcgcgccatcagcgttacttatgacaccccaggacagaggacgctgggcccagagaaaggaggcagaaggaaagccatcttacctgaagagacggtgaccattgtcccttggccccagatatcaaaaggtcgaccgttacttatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggcgttacttatgacaccctgagcgggctggcaaggc

SEQ ID NO: 2224 - DNA, 495 bp, Artificial Sequence
  Synthetic Template Oligonucleotide for IgH VJ Locus
gcctccctcgcgccatcagcgttacttcttcacgaccaggacagaggacgctgggcccagagaaaggaggcagaaggaaagccatcttacctgaagagacggtgaccattgtcccttggccccagatatcaaaaggtcgaccgttacttcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacaccgttacttcttcacgactgagcgggctggcaaggc

SEQ ID NO: 2225 - DNA, 495 bp, Artificial Sequence
  Synthetic Template Oligonucleotide for IgH VJ Locus
gcctccctcgcgccatcagcgttacttagaatcagccaggacagaggacgctgggcccagagaaaggaggcagaaggaaagccatcttacctgaagagacggtgaccattgtcccttggccccagatatcaaaaggtcgaccgttacttagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacacccgttacttagaatcagctgagcgggctggcaaggc

SEQ ID NO: 2226 - DNA, 495 bp, Artificial Sequence
  Synthetic Template Oligonucleotide for IgH VJ Locus
gcctccctcgcgccatcagcgttacttagttatgcccaggacagaggacgctgggcccagagaaaggaggcagaaggaaagccatcttacctgaagagacggtgaccattgtcccttggccccagatatcaaaaggtcgaccgttacttagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataacgttacttagttatgcctgagcgggctggcaaggc

SEQ ID NO: 2227 - DNA, 495 bp, Artificial Sequence
  Synthetic Template Oligonucleotide for IgH VJ Locus
gcctccctcgcgccatcagcgttacttaggtctcaccaggacagaggacgctgggcccagagaaaggaggcagaaggaaagccatcttacctgaagagacggtgaccattgtcccttggccccagatatcaaaaggtcgaccgttacttaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacccgttacttaggtctcactgagcgggctggcaaggc

SEQ ID NO: 2228 - DNA, 495 bp, Artificial Sequence
  Synthetic Template Oligonucleotide for IgH VJ Locus
gcctccctcgcgccatcagcgttacttgtcatagtccaggacagaggacgctgggcccagagaaaggaggcagaaggaaagccatcttacctgaagagacggtgaccattgtcccttggccccagatatcaaaaggtcgaccgttacttgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtcgttacttgtcatagtctgagcgggctggcaaggc

SEQ ID NO: 2229 - DNA, 495 bp, Artificial Sequence
  Synthetic Template Oligonucleotide for IgH VJ Locus
gcctccctcgcgccatcagcgttacttgtgacttgccaggacagaggacgctgggcccagagaaaggaggcagaaggaaagccatcttacctgaagagacggtgaccattgtcccttggccccagatatcaaaaggtcgaccgttacttgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgcgttacttgtgacttgctgagcgggctggcaaggc

SEQ ID NO: 2230 - DNA, 495 bp, Artificial Sequence
  Synthetic Template Oligonucleotide for IgH VJ Locus
gcctccctcgcgccatcagcgttacttgattgcagccaggacagaggacgctgggcccagagaaaggaggcagaaggaaagccatcttacctgaagagacggtgaccattgtcccttggccccagatatcaaaaggtcgaccgttacttgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacccgttacttgattgcagctgagcgggctggcaaggc

SEQ ID NO: 2231 - DNA, 495 bp, Artificial Sequence
  Synthetic Template Oligonucleotide for IgH VJ Locus
gcctccctcgcgccatcagcgttacttactatgacccaggacagaggacgctgggcccagagaaaggaggcagaaggaaagccatcttacctgaagagacggtgaccattgtcccttggccccagatatcaaaaggtcgaccgttacttactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaaccgttacttactatgacctgagcgggctggcaaggc

SEQ ID NO: 2232 - DNA, 495 bp, Artificial Sequence
  Synthetic Template Oligonucleotide for IgH VJ Locus
gcctccctcgcgccatcagcgttacttatggtcaaccaggacagaggacgctgggcccagagaaaggaggcagaaggaaagccatcttacctgaagagacggtgaccattgtcccttggccccagatatcaaaaggtcgaccgttacttatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagaccgttacttatggtcaactgagcgggctggcaaggc

SEQ ID NO: 2233 - DNA, 495 bp, Artificial Sequence
  Synthetic Template Oligonucleotide for IgH VJ Locus
gcctccctcgcgccatcagcgttacttgatggcttccaggacagaggacgctgggcccagagaaaggaggcagaaggaaagccatcttacctgaagagacggtgaccattgtcccttggccccagatatcaaaaggtcgaccgttacttgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaaccgttacttgatggcttctgagcgggctggcaaggc

SEQ ID NO: 2234 - DNA, 495 bp, Artificial Sequence
  Synthetic Template Oligonucleotide for IgH VJ Locus
gcctccctcgcgccatcagcgttacttagcatatgccaggacagaggacgctgggcccagagaaaggaggcagaaggaaagccatcttacctgaagagacggtgaccattgtcccttggccccagatatcaaaaggtcgaccgttacttagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagaccgttacttagcatatgctgagcgggctggcaaggc

SEQ ID NO: 2235 - DNA, 495 bp, Artificial Sequence
  Synthetic Template Oligonucleotide for IgH VJ Locus
gcctccctcgcgccatcagcgttacttcatatgctccaggacagaggacgctgggcccagagaaaggaggcagaaggaaagccatcttacctgaagagacggtgaccattgtcccttggccccagatatcaaaaggtcgaccgttacttcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgcgttacttcatatgctctgagcgggctggcaaggc

SEQ ID NO: 2236 - DNA, 495 bp, Artificial Sequence
  Synthetic Template Oligonucleotide for IgH VJ Locus
gcctccctcgcgccatcagcgttactttcgtcgatccaggacagaggacgctgggcccagagaaaggaggcagaaggaaagccatcttacctgaagagacggtgaccattgtcccttggccccagatatcaaaaggtcgaccgttactttcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacacccgttactttcgtcgatctgagcgggctggcaaggc

SEQ ID NO: 2237 - DNA, 495 bp, Artificial Sequence
  Synthetic Template Oligonucleotide for IgH VJ Locus
gcctccctcgcgccatcagcgttacttcagtctgtccaggacagaggacgctgggcccagagaaaggaggcagaaggaaagccatcttacctgaagagacggtgaccattgtcccttggccccagatatcaaaaggtcgaccgttacttcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgccgttacttcagtctgtctgagcgggctggcaaggc

SEQ ID NO: 2238 - DNA, 495 bp, Artificial Sequence
  Synthetic Template Oligonucleotide for IgH VJ Locus
gcctccctcgcgccatcagcgttacttaacgcgtaccaggacagaggacgctgggcccagagaaaggaggcagaaggaaagccatcttacctgaagagacggtgaccattgtcccttggccccagatatcaaaaggtcgaccgttacttaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgcgttacttaacgcgtactgagcgggctggcaaggc

SEQ ID NO: 2239 - DNA, 495 bp, Artificial Sequence
  Synthetic Template Oligonucleotide for IgH VJ Locus
gcctccctcgcgccatcagcgttacttgtagttcgccaggacagaggacgctgggcccagagaaaggaggcagaaggaaagccatcttacctgaagagacggtgaccattgtcccttggccccagatatcaaaaggtcgaccgttacttgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgccgttacttgtagttcgctgagcgggctggcaaggc

SEQ ID NO: 2240 - DNA, 495 bp, Artificial Sequence
  Synthetic Template Oligonucleotide for IgH VJ Locus
gcctccctcgcgccatcagcgttacttcgaactacccaggacagaggacgctgggcccagagaaaggaggcagaaggaaagccatcttacctgaagagacggtgaccattgtcccttggccccagatatcaaaaggtcgaccgttacttcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagaccgttacttcgaactacctgagcgggctggcaaggc

SEQ ID NO: 2241 - DNA, 495 bp, Artificial Sequence
  Synthetic Template Oligonucleotide for IgH VJ Locus
gcctccctcgcgccatcagcgttacttttaacgtcccaggacagaggacgctgggcccagagaaaggaggcagaaggaaagccatcttacctgaagagacggtgaccattgtcccttggccccagatatcaaaaggtcgaccgttacttttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacacccgttacttttaacgtcctgagcgggctggcaaggc

SEQ ID NO: 2242 - DNA, 495 bp, Artificial Sequence
  Synthetic Template Oligonucleotide for IgH VJ Locus
gcctccctcgcgccatcagcgttacttagcaacctccaggacagaggacgctgggcccagagaaaggaggcagaaggaaagccatcttacctgaagagacggtgaccattgtcccttggccccagatatcaaaaggtcgaccgttacttagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggaccgttacttagcaacctctgagcgggctggcaaggc

SEQ ID NO: 2243 - DNA, 495 bp, Artificial Sequence
  Synthetic Template Oligonucleotide for IgH VJ Locus
gcctccctcgcgccatcagcgttacttttctcgagccaggacagaggacgctgggcccagagaaaggaggcagaaggaaagccatcttacctgaagagacggtgaccattgtcccttggccccagatatcaaaaggtcgaccgttacttttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttcgttacttttctcgagctgagcgggctggcaaggc

SEQ ID NO: 2244 - DNA, 495 bp, Artificial Sequence
  Synthetic Template Oligonucleotide for IgH VJ Locus
gcctccctcgcgccatcagcgttacttactctacgccaggacagaggacgctgggcccagagaaaggaggcagaaggaaagccatcttacctgaagagacggtgaccattgtcccttggccccagatatcaaaaggtcgaccgttacttactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggaccgttacttactctacgctgagcgggctggcaaggc

SEQ ID NO: 2245 - DNA, 495 bp, Artificial Sequence
  Synthetic Template Oligonucleotide for IgH VJ Locus
gcctccctcgcgccatcagcgttactttaccggaaccaggacagaggacgctgggcccagagaaaggaggcagaaggaaagccatcttacctgaagagacggtgaccattgtcccttggccccagatatcaaaaggtcgaccgttactttaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacacccgttactttaccggaactgagcgggctggcaaggc

SEQ ID NO: 2246 - DNA, 495 bp, Artificial Sequence
  Synthetic Template Oligonucleotide for IgH VJ Locus
gcctccctcgcgccatcagcgttacttcgaattgcccaggacagaggacgctgggcccagagaaaggaggcagaaggaaagccatcttacctgaagagacggtgaccattgtcccttggccccagatatcaaaaggtcgaccgttacttcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaaccgttacttcgaattgcctgagcgggctggcaaggc

SEQ ID NO: 2247 - DNA, 495 bp, Artificial Sequence
  Synthetic Template Oligonucleotide for IgH VJ Locus
gcctccctcgcgccatcagcgttacttttcgctcaccaggacagaggacgctgggcccagagaaaggaggcagaaggaaagccatcttacctgaagagacggtgaccattgtcccttggccccagatatcaaaaggtcgaccgttacttttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacacgttacttttcgctcactgagcgggctggcaaggc

SEQ ID NO: 2248 - DNA, 495 bp, Artificial Sequence
  Synthetic Template Oligonucleotide for IgH VJ Locus
gcctccctcgcgccatcagcgttacttgacgttaaccaggacagaggacgctgggcccagagaaaggaggcagaaggaaagccatcttacctgaagagacggtgaccattgtcccttggccccagatatcaaaaggtcgaccgttacttgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgcgttacttgacgttaactgagcgggctggcaaggc

SEQ ID NO: 2249 - DNA, 495 bp, Artificial Sequence
  Synthetic Template Oligonucleotide for IgH VJ Locus
gcctccctcgcgccatcagcgttacttcgtagagtccaggacagaggacgctgggcccagagaaaggaggcagaaggaaagccatcttacctgaagagacggtgaccattgtcccttggccccagatatcaaaaggtcgaccgttacttcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgccgttacttcgtagagtctgagcgggctggcaaggc

SEQ ID NO: 2250 - DNA, 495 bp, Artificial Sequence
  Synthetic Template Oligonucleotide for IgH VJ Locus
gcctccctcgcgccatcagcgttacttttccggtaccaggacagaggacgctgggcccagagaaaggaggcagaaggaaagccatcttacctgaagagacggtgaccattgtcccttggccccagatatcaaaaggtcgaccgttacttttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgccgttacttttccggtactgagcgggctggcaaggc

SEQ ID NO: 2251 - DNA, 495 bp, Artificial Sequence
  Synthetic Template Oligonucleotide for IgH VJ Locus
gcctccctcgcgccatcagcgttacttgcaattcgccaggacagaggacgctgggcccagagaaaggaggcagaaggaaagccatcttacctgaagagacggtgaccattgtcccttggccccagatatcaaaaggtcgaccgttacttgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacaccgttacttgcaattcgctgagcgggctggcaaggc

SEQ ID NO: 2252 - DNA, 495 bp, Artificial Sequence
  Synthetic Template Oligonucleotide for IgH VJ Locus
gcctccctcgcgccatcagcgttactttgagcgaaccaggacagaggacgctgggcccagagaaaggaggcagaaggaaagccatcttacctgaagagacggtgaccattgtcccttggccccagatatcaaaaggtcgaccgttactttgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgccgttactttgagcgaactgagcgggctggcaaggc

SEQ ID NO: 2253 - DNA, 495 bp, Artificial Sequence
  Synthetic Template Oligonucleotide for IgH VJ Locus
gcctccctcgcgccatcagcgttactttactaagcccaggacagaggacgctgggcccagagaaaggaggcagaaggaaagccatcttacctgaagagacggtgaccattgtcccttggccccagatatcaaaaggtcgaccgttactttactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggacccccgttactttactaagcctgagcgggctggcaaggc

SEQ ID NO: 2254 - DNA, 495 bp, Artificial Sequence
  Synthetic Template Oligonucleotide for IgH VJ Locus
gcctccctcgcgccatcagcgttactttggcgtatccaggacagaggacgctgggcccagagaaaggaggcagaaggaaagccatcttacctgaagagacggtgaccattgtcccttggccccagatatcaaaaggtcgaccgttactttggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtcgttactttggcgtatctgagcgggctggcaaggc

SEQ ID NO: 2255 - DNA, 495 bp, Artificial Sequence
  Synthetic Template Oligonucleotide for IgH VJ Locus
gcctccctcgcgccatcagcgttacttgataaccaccaggacagaggacgctgggcccagagaaaggaggcagaaggaaagccatcttacctgaagagacggtgaccattgtcccttggccccagatatcaaaaggtcgaccgttacttgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgcgttacttgataaccactgagcgggctggcaaggc

SEQ ID NO: 2256 - DNA, 495 bp, Artificial Sequence
  Synthetic Template Oligonucleotide for IgH VJ Locus
gcctccctcgcgccatcagcgttacttctagtgaaccaggacagaggacgctgggcccagagaaaggaggcagaaggaaagccatcttacctgaagagacggtgaccattgtcccttggccccagatatcaaaaggtcgaccgttacttctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagcgttacttctagtgaactgagcgggctggcaaggc

SEQ ID NO: 2257 - DNA, 495 bp, Artificial Sequence
  Synthetic Template Oligonucleotide for IgH VJ Locus
gcctccctcgcgccatcagcgttacttacgttcacccaggacagaggacgctgggcccagagaaaggaggcagaaggaaagccatcttacctgaagagacggtgaccattgtcccttggccccagatatcaaaaggtcgaccgttacttacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtcgttacttacgttcacctgagcgggctggcaaggc

SEQ ID NO: 2258 - DNA, 448 bp, Artificial Sequence
  Synthetic Template Oligonucleotide for IgH VJ Locus
gcctccctcgcgccatcagcgttacttattacgctccaggacagaggacgctgggcccagagaaaggaggcagaaggaaagccatcttacctgaagagacggtgaccattgtcccttggccccagatatcaaaaggtcgaccgttacttattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcacgttacttattacgctctgagcgggctggcaaggc

SEQ ID NO: 2259 - DNA, 495 bp, Artificial Sequence
  Synthetic Template Oligonucleotide for IgH VJ Locus
gcctccctcgcgccatcagcgttacttcattgagtccaggacagaggacgctgggcccagagaaaggaggcagaaggaaagccatcttacctgaagagacggtgaccattgtcccttggccccagatatcaaaaggtcgaccgttacttcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcacccgttacttcattgagtctgagcgggctggcaaggc

SEQ ID NO: 2260 - DNA, 495 bp, Artificial Sequence
  Synthetic Template Oligonucleotide for IgH VJ Locus
gcctccctcgcgccatcagtaggagaccttggttacagaaatgcagcaaaacccttcagagttaaagcaggagagaggttgtgaggactcacctgaggagacggtgaccagggttccctggccccagtagtcaaagtcgactaggagaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctaggagaccttggttactgagcgggctggcaaggc

SEQ ID NO: 2261 - DNA, 495 bp, Artificial Sequence
  Synthetic Template Oligonucleotide for IgH VJ Locus
gcctccctcgcgccatcagtaggagacacctcttgcagaaatgcagcaaaacccttcagagttaaagcaggagagaggttgtgaggactcacctgaggagacggtgaccagggttccctggccccagtagtcaaagtcgactaggagacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctaggagacacctcttgctgagcgggctggcaaggc

SEQ ID NO: 2262 - DNA, 495 bp, Artificial Sequence
  Synthetic Template Oligonucleotide for IgH VJ Locus
gcctccctcgcgccatcagtaggagacctgattctcagaaatgcagcaaaacccttcagagttaaagcaggagagaggttgtgaggactcacctgaggagacggtgaccagggttccctggccccagtagtcaaagtcgactaggagacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcacctaggagacctgattctctgagcgggctggcaaggc

SEQ ID NO: 2263 - DNA, 495 bp, Artificial Sequence
  Synthetic Template Oligonucleotide for IgH VJ Locus
gcctccctcgcgccatcagtaggagacagtaccgacagaaatgcagcaaaacccttcagagttaaagcaggagagaggttgtgaggactcacctgaggagacggtgaccagggttccctggccccagtagtcaaagtcgactaggagacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcacctaggagacagtaccgactgagcgggctggcaaggc

SEQ ID NO: 2264 - DNA, 495 bp, Artificial Sequence
  Synthetic Template Oligonucleotide for IgH VJ Locus
gcctccctcgcgccatcagtaggagacatccatggcagaaatgcagcaaaacccttcagagttaaagcaggagagaggttgtgaggactcacctgaggagacggtgaccagggttccctggccccagtagtcaaagtcgactaggagacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgcctaggagacatccatggctgagcgggctggcaaggc

SEQ ID NO: 2265 - DNA, 495 bp, Artificial Sequence
  Synthetic Template Oligonucleotide for IgH VJ Locus
gcctccctcgcgccatcagtaggagacgtagcagtcagaaatgcagcaaaacccttcagagttaaagcaggagagaggttgtgaggactcacctgaggagacggtgaccagggttccctggccccagtagtcaaagtcgactaggagacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatctaggagacgtagcagtctgagcgggctggcaaggc

SEQ ID NO: 2266 - DNA, 495 bp, Artificial Sequence
  Synthetic Template Oligonucleotide for IgH VJ Locus
gcctccctcgcgccatcagtaggagacatcttcgtcagaaatgcagcaaaacccttcagagttaaagcaggagagaggttgtgaggactcacctgaggagacggtgaccagggttccctggccccagtagtcaaagtcgactaggagacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacctaggagacatcttcgtctgagcgggctggcaaggc

SEQ ID NO: 2267 - DNA, 495 bp, Artificial Sequence
  Synthetic Template Oligonucleotide for IgH VJ Locus
gcctccctcgcgccatcagtaggagactccacagtcagaaatgcagcaaaacccttcagagttaaagcaggagagaggttgtgaggactcacctgaggagacggtgaccagggttccctggccccagtagtcaaagtcgactaggagactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcacctaggagactccacagtctgagcgggctggcaaggc

SEQ ID NO: 2268 - DNA, 495 bp, Artificial Sequence
  Synthetic Template Oligonucleotide for IgH VJ Locus
gcctccctcgcgccatcagtaggagacagctagtgcagaaatgcagcaaaacccttcagagttaaagcaggagagaggttgtgaggactcacctgaggagacggtgaccagggttccctggccccagtagtcaaagtcgactaggagacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacacctaggagacagctagtgctgagcgggctggcaaggc

SEQ ID NO: 2269 - DNA, 495 bp, Artificial Sequence
  Synthetic Template Oligonucleotide for IgH VJ Locus
gcctccctcgcgccatcagtaggagactaaccaagcagaaatgcagcaaaacccttcagagttaaagcaggagagaggttgtgaggactcacctgaggagacggtgaccagggttccctggccccagtagtcaaagtcgactaggagactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcacctaggagactaaccaagctgagcgggctggcaaggc

SEQ ID NO: 2270 - DNA, 495 bp, Artificial Sequence
  Synthetic Template Oligonucleotide for IgH VJ Locus
gcctccctcgcgccatcagtaggagaccaagaggtcagaaatgcagcaaaacccttcagagttaaagcaggagagaggttgtgaggactcacctgaggagacggtgaccagggttccctggccccagtagtcaaagtcgactaggagaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgcctaggagaccaagaggtctgagcgggctggcaaggc

SEQ ID NO: 2271 - DNA, 495 bp, Artificial Sequence
  Synthetic Template Oligonucleotide for IgH VJ Locus
gcctccctcgcgccatcagtaggagacagttgacccagaaatgcagcaaaacccttcagagttaaagcaggagagaggttgtgaggactcacctgaggagacggtgaccagggttccctggccccagtagtcaaagtcgactaggagacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaataggagacagttgaccctgagcgggctggcaaggc

SEQ ID NO: 2272 - DNA, 495 bp, Artificial Sequence
  Synthetic Template Oligonucleotide for IgH VJ Locus
gcctccctcgcgccatcagtaggagaccagcatatcagaaatgcagcaaaacccttcagagttaaagcaggagagaggttgtgaggactcacctgaggagacggtgaccagggttccctggccccagtagtcaaagtcgactaggagaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaataggagaccagcatatctgagcgggctggcaaggc

SEQ ID NO: 2273 - DNA, 495 bp, Artificial Sequence
  Synthetic Template Oligonucleotide for IgH VJ Locus
gcctccctcgcgccatcagtaggagacgcaggattcagaaatgcagcaaaacccttcagagttaaagcaggagagaggttgtgaggactcacctgaggagacggtgaccagggttccctggccccagtagtcaaagtcgactaggagacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataataggagacgcaggattctgagcgggctggcaaggc

SEQ ID NO: 2274 - DNA, 495 bp, Artificial Sequence
  Synthetic Template Oligonucleotide for IgH VJ Locus
gcctccctcgcgccatcagtaggagacgtccattccagaaatgcagcaaaacccttcagagttaaagcaggagagaggttgtgaggactcacctgaggagacggtgaccagggttccctggccccagtagtcaaagtcgactaggagacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacctaggagacgtccattcctgagcgggctggcaaggc

SEQ ID NO: 2275 - DNA, 495 bp, Artificial Sequence
  Synthetic Template Oligonucleotide for IgH VJ Locus
gcctccctcgcgccatcagtaggagacgcataactcagaaatgcagcaaaacccttcagagttaaagcaggagagaggttgtgaggactcacctgaggagacggtgaccagggttccctggccccagtagtcaaagtcgactaggagacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggactaggagacgcataactctgagcgggctggcaaggc

SEQ ID NO: 2276 - DNA, 495 bp, Artificial Sequence
  Synthetic Template Oligonucleotide for IgH VJ Locus
gcctccctcgcgccatcagtaggagacatatgctgcagaaatgcagcaaaacccttcagagttaaagcaggagagaggttgtgaggactcacctgaggagacggtgaccagggttccctggccccagtagtcaaagtcgactaggagacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacacctaggagacatatgctgctgagcgggctggcaaggc

SEQ ID NO: 2277 - DNA, 495 bp, Artificial Sequence
  Synthetic Template Oligonucleotide for IgH VJ Locus
gcctccctcgcgccatcagtaggagacaatcctgccagaaatgcagcaaaacccttcagagttaaagcaggagagaggttgtgaggactcacctgaggagacggtgaccagggttccctggccccagtagtcaaagtcgactaggagacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgctaggagacaatcctgcctgagcgggctggcaaggc

SEQ ID NO: 2278 - DNA, 495 bp, Artificial Sequence
  Synthetic Template Oligonucleotide for IgH VJ Locus
gcctccctcgcgccatcagtaggagactgagacctcagaaatgcagcaaaacccttcagagttaaagcaggagagaggttgtgaggactcacctgaggagacggtgaccagggttccctggccccagtagtcaaagtcgactaggagactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgtaggagactgagacctctgagcgggctggcaaggc

SEQ ID NO: 2279 - DNA, 495 bp, Artificial Sequence
  Synthetic Template Oligonucleotide for IgH VJ Locus
gcctccctcgcgccatcagtaggagacgaatggaccagaaatgcagcaaaacccttcagagttaaagcaggagagaggttgtgaggactcacctgaggagacggtgaccagggttccctggccccagtagtcaaagtcgactaggagacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacacctaggagacgaatggacctgagcgggctggcaaggc

SEQ ID NO: 2280 - DNA, 495 bp, Artificial Sequence
  Synthetic Template Oligonucleotide for IgH VJ Locus
gcctccctcgcgccatcagtaggagaccacatggacagaaatgcagcaaaacccttcagagttaaagcaggagagaggttgtgaggactcacctgaggagacggtgaccagggttccctggccccagtagtcaaagtcgactaggagaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacacctaggagaccacatggactgagcgggctggcaaggc

SEQ ID NO: 2281 - DNA, 495 bp, Artificial Sequence
  Synthetic Template Oligonucleotide for IgH VJ Locus
gcctccctcgcgccatcagtaggagacttgaccatcagaaatgcagcaaaacccttcagagttaaagcaggagagaggttgtgaggactcacctgaggagacggtgaccagggttccctggccccagtagtcaaagtcgactaggagacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacacctaggagacttgaccatctgagcgggctggcaaggc

SEQ ID NO: 2282 - DNA, 495 bp, Artificial Sequence
  Synthetic Template Oligonucleotide for IgH VJ Locus
gcctccctcgcgccatcagtaggagacaagccatccagaaatgcagcaaaacccttcagagttaaagcaggagagaggttgtgaggactcacctgaggagacggtgaccagggttccctggccccagtagtcaaagtcgactaggagacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacacctaggagacaagccatcctgagcgggctggcaaggc

SEQ ID NO: 2283 - DNA, 495 bp, Artificial Sequence
  Synthetic Template Oligonucleotide for IgH VJ Locus
gcctccctcgcgccatcagtaggagactccatgtgcagaaatgcagcaaaacccttcagagttaaagcaggagagaggttgtgaggactcacctgaggagacggtgaccagggttccctggccccagtagtcaaagtcgactaggagactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctaggagactccatgtgctgagcgggctggcaaggc

SEQ ID NO: 2284 - DNA, 495 bp, Artificial Sequence
  Synthetic Template Oligonucleotide for IgH VJ Locus
gcctccctcgcgccatcagtaggagaccaagtcaccagaaatgcagcaaaacccttcagagttaaagcaggagagaggttgtgaggactcacctgaggagacggtgaccagggttccctggccccagtagtcaaagtcgactaggagaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctaggagaccaagtcacctgagcgggctggcaaggc

SEQ ID NO: 2285 - DNA, 495 bp, Artificial Sequence
  Synthetic Template Oligonucleotide for IgH VJ Locus
gcctccctcgcgccatcagtaggagacctgcaatccagaaatgcagcaaaacccttcagagttaaagcaggagagaggttgtgaggactcacctgaggagacggtgaccagggttccctggccccagtagtcaaagtcgactaggagacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacacctaggagacctgcaatcctgagcgggctggcaaggc

SEQ ID NO: 2286 - DNA, 495 bp, Artificial Sequence
  Synthetic Template Oligonucleotide for IgH VJ Locus
gcctccctcgcgccatcagtaggagacatcgacgacagaaatgcagcaaaacccttcagagttaaagcaggagagaggttgtgaggactcacctgaggagacggtgaccagggttccctggccccagtagtcaaagtcgactaggagacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacacctaggagacatcgacgactgagcgggctggcaaggc

SEQ ID NO: 2287 - DNA, 495 bp, Artificial Sequence
  Synthetic Template Oligonucleotide for IgH VJ Locus
gcctccctcgcgccatcagtaggagacacagactgcagaaatgcagcaaaacccttcagagttaaagcaggagagaggttgtgaggactcacctgaggagacggtgaccagggttccctggccccagtagtcaaagtcgactaggagacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaataggagacacagactgctgagcgggctggcaaggc

SEQ ID NO: 2288 - DNA, 495 bp, Artificial Sequence
  Synthetic Template Oligonucleotide for IgH VJ Locus
gcctccctcgcgccatcagtaggagacccttatagcagaaatgcagcaaaacccttcagagttaaagcaggagagaggttgtgaggactcacctgaggagacggtgaccagggttccctggccccagtagtcaaagtcgactaggagacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggactaggagacccttatagctgagcgggctggcaaggc

SEQ ID NO: 2289 - DNA, 495 bp, Artificial Sequence
  Synthetic Template Oligonucleotide for IgH VJ Locus
gcctccctcgcgccatcagtaggagactacgcgttcagaaatgcagcaaaacccttcagagttaaagcaggagagaggttgtgaggactcacctgaggagacggtgaccagggttccctggccccagtagtcaaagtcgactaggagactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacacctaggagactacgcgttctgagcgggctggcaaggc

SEQ ID NO: 2290 - DNA, 495 bp, Artificial Sequence
  Synthetic Template Oligonucleotide for IgH VJ Locus
gcctccctcgcgccatcagtaggagacctataaggcagaaatgcagcaaaacccttcagagttaaagcaggagagaggttgtgaggactcacctgaggagacggtgaccagggttccctggccccagtagtcaaagtcgactaggagacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgtaggagacctataaggctgagcgggctggcaaggc

SEQ ID NO: 2291 - DNA, 495 bp, Artificial Sequence
  Synthetic Template Oligonucleotide for IgH VJ Locus
gcctccctcgcgccatcagtaggagactcttagtccagaaatgcagcaaaacccttcagagttaaagcaggagagaggttgtgaggactcacctgaggagacggtgaccagggttccctggccccagtagtcaaagtcgactaggagactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgctaggagactcttagtcctgagcgggctggcaaggc

SEQ ID NO: 2292 - DNA, 495 bp, Artificial Sequence
  Synthetic Template Oligonucleotide for IgH VJ Locus
gcctccctcgcgccatcagtaggagactgtctgcacagaaatgcagcaaaacccttcagagttaaagcaggagagaggttgtgaggactcacctgaggagacggtgaccagggttccctggccccagtagtcaaagtcgactaggagactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacacctaggagactgtctgcactgagcgggctggcaaggc

SEQ ID NO: 2293 - DNA, 495 bp, Artificial Sequence
  Synthetic Template Oligonucleotide for IgH VJ Locus
gcctccctcgcgccatcagtaggagacgccattaacagaaatgcagcaaaacccttcagagttaaagcaggagagaggttgtgaggactcacctgaggagacggtgaccagggttccctggccccagtagtcaaagtcgactaggagacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgctaggagacgccattaactgagcgggctggcaaggc

SEQ ID NO: 2294 - DNA, 495 bp, Artificial Sequence
  Synthetic Template Oligonucleotide for IgH VJ Locus
gcctccctcgcgccatcagtaggagacgactaagacagaaatgcagcaaaacccttcagagttaaagcaggagagaggttgtgaggactcacctgaggagacggtgaccagggttccctggccccagtagtcaaagtcgactaggagacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgtaggagacgactaagactgagcgggctggcaaggc

SEQ ID NO: 2295 - DNA, 495 bp, Artificial Sequence
  Synthetic Template Oligonucleotide for IgH VJ Locus
gcctccctcgcgccatcagtaggagacaggttgctcagaaatgcagcaaaacccttcagagttaaagcaggagagaggttgtgaggactcacctgaggagacggtgaccagggttccctggccccagtagtcaaagtcgactaggagacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgtaggagacaggttgctctgagcgggctggcaaggc

SEQ ID NO: 2296 - DNA, 495 bp, Artificial Sequence
  Synthetic Template Oligonucleotide for IgH VJ Locus
gcctccctcgcgccatcagtaggagacctcgagaacagaaatgcagcaaaacccttcagagttaaagcaggagagaggttgtgaggactcacctgaggagacggtgaccagggttccctggccccagtagtcaaagtcgactaggagacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacacctaggagacctcgagaactgagcgggctggcaaggc

SEQ ID NO: 2297 - DNA, 495 bp, Artificial Sequence
  Synthetic Template Oligonucleotide for IgH VJ Locus
gcctccctcgcgccatcagtaggagacttaatggccagaaatgcagcaaaacccttcagagttaaagcaggagagaggttgtgaggactcacctgaggagacggtgaccagggttccctggccccagtagtcaaagtcgactaggagacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacacctaggagacttaatggcctgagcgggctggcaaggc

SEQ ID NO: 2298 - DNA, 495 bp, Artificial Sequence
  Synthetic Template Oligonucleotide for IgH VJ Locus
gcctccctcgcgccatcagtaggagactgcagacacagaaatgcagcaaaacccttcagagttaaagcaggagagaggttgtgaggactcacctgaggagacggtgaccagggttccctggccccagtagtcaaagtcgactaggagactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaataggagactgcagacactgagcgggctggcaaggc

SEQ ID NO: 2299 - DNA, 495 bp, Artificial Sequence
  Synthetic Template Oligonucleotide for IgH VJ Locus
gcctccctcgcgccatcagtaggagactcactgagcagaaatgcagcaaaacccttcagagttaaagcaggagagaggttgtgaggactcacctgaggagacggtgaccagggttccctggccccagtagtcaaagtcgactaggagactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgttaggagactcactgagctgagcgggctggcaaggc

SEQ ID NO: 2300 - DNA, 495 bp, Artificial Sequence
  Synthetic Template Oligonucleotide for IgH VJ Locus
gcctccctcgcgccatcagtaggagacgagtacgtcagaaatgcagcaaaacccttcagagttaaagcaggagagaggttgtgaggactcacctgaggagacggtgaccagggttccctggccccagtagtcaaagtcgactaggagacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccactaggagacgagtacgtctgagcgggctggcaaggc

SEQ ID NO: 2301 - DNA, 495 bp, Artificial Sequence
  Synthetic Template Oligonucleotide for IgH VJ Locus
gcctccctcgcgccatcagtaggagacatacgccacagaaatgcagcaaaacccttcagagttaaagcaggagagaggttgtgaggactcacctgaggagacggtgaccagggttccctggccccagtagtcaaagtcgactaggagacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggactaggagacatacgccactgagcgggctggcaaggc

SEQ ID NO: 2302 - DNA, 495 bp, Artificial Sequence
  Synthetic Template Oligonucleotide for IgH VJ Locus
gcctccctcgcgccatcagtaggagactcgcatcacagaaatgcagcaaaacccttcagagttaaagcaggagagaggttgtgaggactcacctgaggagacggtgaccagggttccctggccccagtagtcaaagtcgactaggagactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggactaggagactcgcatcactgagcgggctggcaaggc

SEQ ID NO: 2303 - DNA, 495 bp, Artificial Sequence
  Synthetic Template Oligonucleotide for IgH VJ Locus
gcctccctcgcgccatcagtaggagaccgcttaatcagaaatgcagcaaaacccttcagagttaaagcaggagagaggttgtgaggactcacctgaggagacggtgaccagggttccctggccccagtagtcaaagtcgactaggagaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggactaggagaccgcttaatctgagcgggctggcaaggc

SEQ ID NO: 2304 - DNA, 495 bp, Artificial Sequence
  Synthetic Template Oligonucleotide for IgH VJ Locus
gcctccctcgcgccatcagtaggagactggttatccagaaatgcagcaaaacccttcagagttaaagcaggagagaggttgtgaggactcacctgaggagacggtgaccagggttccctggccccagtagtcaaagtcgactaggagactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgttaggagactggttatcctgagcgggctggcaaggc

SEQ ID NO: 2305 - DNA, 495 bp, Artificial Sequence
  Synthetic Template Oligonucleotide for IgH VJ Locus
gcctccctcgcgccatcagtaggagacggattgctcagaaatgcagcaaaacccttcagagttaaagcaggagagaggttgtgaggactcacctgaggagacggtgaccagggttccctggccccagtagtcaaagtcgactaggagacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggactaggagacggattgctctgagcgggctggcaaggc

SEQ ID NO: 2306 - DNA, 495 bp, Artificial Sequence
  Synthetic Template Oligonucleotide for IgH VJ Locus
gcctccctcgcgccatcagtaggagacctcagtgacagaaatgcagcaaaacccttcagagttaaagcaggagagaggttgtgaggactcacctgaggagacggtgaccagggttccctggccccagtagtcaaagtcgactaggagacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgttaggagacctcagtgactgagcgggctggcaaggc

SEQ ID NO: 2307 - DNA, 495 bp, Artificial Sequence
  Synthetic Template Oligonucleotide for IgH VJ Locus
gcctccctcgcgccatcagtaggagacacgtactccagaaatgcagcaaaacccttcagagttaaagcaggagagaggttgtgaggactcacctgaggagacggtgaccagggttccctggccccagtagtcaaagtcgactaggagacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggactaggagacacgtactcctgagcgggctggcaaggc

SEQ ID NO: 2308 - DNA, 495 bp, Artificial Sequence
  Synthetic Template Oligonucleotide for IgH VJ Locus
gcctccctcgcgccatcagtaggagactgatgcgacagaaatgcagcaaaacccttcagagttaaagcaggagagaggttgtgaggactcacctgaggagacggtgaccagggttccctggccccagtagtcaaagtcgactaggagactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggacccctaggagactgatgcgactgagcgggctggcaaggc

SEQ ID NO: 2309 - DNA, 495 bp, Artificial Sequence
  Synthetic Template Oligonucleotide for IgH VJ Locus
gcctccctcgcgccatcagtaggagacattaagcgcagaaatgcagcaaaacccttcagagttaaagcaggagagaggttgtgaggactcacctgaggagacggtgaccagggttccctggccccagtagtcaaagtcgactaggagacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactcctaggagacattaagcgctgagcgggctggcaaggc

SEQ ID NO: 2310 - DNA, 495 bp, Artificial Sequence
  Synthetic Template Oligonucleotide for IgH VJ Locus
gcctccctcgcgccatcagtaggagacagcaatcccagaaatgcagcaaaacccttcagagttaaagcaggagagaggttgtgaggactcacctgaggagacggtgaccagggttccctggccccagtagtcaaagtcgactaggagacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactcctaggagacagcaatccctgagcgggctggcaaggc

SEQ ID NO: 2311 - DNA, 495 bp, Artificial Sequence
  Synthetic Template Oligonucleotide for IgH VJ Locus
gcctccctcgcgccatcagtaggagacgcttagtacagaaatgcagcaaaacccttcagagttaaagcaggagagaggttgtgaggactcacctgaggagacggtgaccagggttccctggccccagtagtcaaagtcgactaggagacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgataggagacgcttagtactgagcgggctggcaaggc

SEQ ID NO: 2312 - DNA, 495 bp, Artificial Sequence
  Synthetic Template Oligonucleotide for IgH VJ Locus
gcctccctcgcgccatcagtaggagactgaccttgcagaaatgcagcaaaacccttcagagttaaagcaggagagaggttgtgaggactcacctgaggagacggtgaccagggttccctggccccagtagtcaaagtcgactaggagactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcacctaggagactgaccttgctgagcgggctggcaaggc

SEQ ID NO: 2313 - DNA, 495 bp, Artificial Sequence
  Synthetic Template Oligonucleotide for IgH VJ Locus
gcctccctcgcgccatcagtaggagaccaaggtcacagaaatgcagcaaaacccttcagagttaaagcaggagagaggttgtgaggactcacctgaggagacggtgaccagggttccctggccccagtagtcaaagtcgactaggagaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtacctaggagaccaaggtcactgagcgggctggcaaggc

SEQ ID NO: 2314 - DNA, 495 bp, Artificial Sequence
  Synthetic Template Oligonucleotide for IgH VJ Locus
gcctccctcgcgccatcagtaggagaccactgtaccagaaatgcagcaaaacccttcagagttaaagcaggagagaggttgtgaggactcacctgaggagacggtgaccagggttccctggccccagtagtcaaagtcgactaggagaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttctaggagaccactgtacctgagcgggctggcaaggc

SEQ ID NO: 2315 - DNA, 495 bp, Artificial Sequence
  Synthetic Template Oligonucleotide for IgH VJ Locus
gcctccctcgcgccatcagtaggagacgatgatcccagaaatgcagcaaaacccttcagagttaaagcaggagagaggttgtgaggactcacctgaggagacggtgaccagggttccctggccccagtagtcaaagtcgactaggagacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggtaggagacgatgatccctgagcgggctggcaaggc

SEQ ID NO: 2316 - DNA, 495 bp, Artificial Sequence
  Synthetic Template Oligonucleotide for IgH VJ Locus
gcctccctcgcgccatcagtaggagaccgccaatacagaaatgcagcaaaacccttcagagttaaagcaggagagaggttgtgaggactcacctgaggagacggtgaccagggttccctggccccagtagtcaaagtcgactaggagaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggtaggagaccgccaatactgagcgggctggcaaggc

SEQ ID NO: 2317 - DNA, 495 bp, Artificial Sequence
  Synthetic Template Oligonucleotide for IgH VJ Locus
gcctccctcgcgccatcagtaggagactcaagcctcagaaatgcagcaaaacccttcagagttaaagcaggagagaggttgtgaggactcacctgaggagacggtgaccagggttccctggccccagtagtcaaagtcgactaggagactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacataggagactcaagcctctgagcgggctggcaaggc

SEQ ID NO: 2318 - DNA, 495 bp, Artificial Sequence
  Synthetic Template Oligonucleotide for IgH VJ Locus
gcctccctcgcgccatcagtaggagacacgtgtgtcagaaatgcagcaaaacccttcagagttaaagcaggagagaggttgtgaggactcacctgaggagacggtgaccagggttccctggccccagtagtcaaagtcgactaggagacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagtaggagacacgtgtgtctgagcgggctggcaaggc

SEQ ID NO: 2319 - DNA, 495 bp, Artificial Sequence
  Synthetic Template Oligonucleotide for IgH VJ Locus
gcctccctcgcgccatcagtaggagactccgtctacagaaatgcagcaaaacccttcagagttaaagcaggagagaggttgtgaggactcacctgaggagacggtgaccagggttccctggccccagtagtcaaagtcgactaggagactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagtaggagactccgtctactgagcgggctggcaaggc

SEQ ID NO: 2320 - DNA, 495 bp, Artificial Sequence
  Synthetic Template Oligonucleotide for IgH VJ Locus
gcctccctcgcgccatcagtaggagacaagagctgcagaaatgcagcaaaacccttcagagttaaagcaggagagaggttgtgaggactcacctgaggagacggtgaccagggttccctggccccagtagtcaaagtcgactaggagacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgtaggagacaagagctgctgagcgggctggcaaggc

SEQ ID NO: 2321 - DNA, 495 bp, Artificial Sequence
  Synthetic Template Oligonucleotide for IgH VJ Locus
gcctccctcgcgccatcagtaggagactatcgctccagaaatgcagcaaaacccttcagagttaaagcaggagagaggttgtgaggactcacctgaggagacggtgaccagggttccctggccccagtagtcaaagtcgactaggagactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagtaggagactatcgctcctgagcgggctggcaaggc

SEQ ID NO: 2322 - DNA, 495 bp, Artificial Sequence
  Synthetic Template Oligonucleotide for IgH VJ Locus
gcctccctcgcgccatcagtaggagactcagatgccagaaatgcagcaaaacccttcagagttaaagcaggagagaggttgtgaggactcacctgaggagacggtgaccagggttccctggccccagtagtcaaagtcgactaggagactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaaccctaggagactcagatgcctgagcgggctggcaaggc

SEQ ID NO: 2323 - DNA, 495 bp, Artificial Sequence
  Synthetic Template Oligonucleotide for IgH VJ Locus
gcctccctcgcgccatcagtaggagacgtgtagcacagaaatgcagcaaaacccttcagagttaaagcaggagagaggttgtgaggactcacctgaggagacggtgaccagggttccctggccccagtagtcaaagtcgactaggagacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgtaggagacgtgtagcactgagcgggctggcaaggc

SEQ ID NO: 2324 - DNA, 495 bp, Artificial Sequence
  Synthetic Template Oligonucleotide for IgH VJ Locus
gcctccctcgcgccatcagtaggagactggcagttcagaaatgcagcaaaacccttcagagttaaagcaggagagaggttgtgaggactcacctgaggagacggtgaccagggttccctggccccagtagtcaaagtcgactaggagactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgtaggagactggcagttctgagcgggctggcaaggc

SEQ ID NO: 2325 - DNA, 495 bp, Artificial Sequence
  Synthetic Template Oligonucleotide for IgH VJ Locus
gcctccctcgcgccatcagtaggagaccagtccaacagaaatgcagcaaaacccttcagagttaaagcaggagagaggttgtgaggactcacctgaggagacggtgaccagggttccctggccccagtagtcaaagtcgactaggagaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcactaggagaccagtccaactgagcgggctggcaaggc

SEQ ID NO: 2326 - DNA, 495 bp, Artificial Sequence
  Synthetic Template Oligonucleotide for IgH VJ Locus
gcctccctcgcgccatcagtaggagacgtgtctaccagaaatgcagcaaaacccttcagagttaaagcaggagagaggttgtgaggactcacctgaggagacggtgaccagggttccctggccccagtagtcaaagtcgactaggagacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggtaggagacgtgtctacctgagcgggctggcaaggc

SEQ ID NO: 2327 - DNA, 495 bp, Artificial Sequence
  Synthetic Template Oligonucleotide for IgH VJ Locus
gcctccctcgcgccatcagtaggagacgtacagtgcagaaatgcagcaaaacccttcagagttaaagcaggagagaggttgtgaggactcacctgaggagacggtgaccagggttccctggccccagtagtcaaagtcgactaggagacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagtaggagacgtacagtgctgagcgggctggcaaggc

SEQ ID NO: 2328 - DNA, 495 bp, Artificial Sequence
  Synthetic Template Oligonucleotide for IgH VJ Locus
gcctccctcgcgccatcagtaggagacggatcatccagaaatgcagcaaaacccttcagagttaaagcaggagagaggttgtgaggactcacctgaggagacggtgaccagggttccctggccccagtagtcaaagtcgactaggagacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagtaggagacggatcatcctgagcgggctggcaaggc

SEQ ID NO: 2329 - DNA, 495 bp, Artificial Sequence
  Synthetic Template Oligonucleotide for IgH VJ Locus
gcctccctcgcgccatcagtaggagactattggcgcagaaatgcagcaaaacccttcagagttaaagcaggagagaggttgtgaggactcacctgaggagacggtgaccagggttccctggccccagtagtcaaagtcgactaggagactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcataggagactattggcgctgagcgggctggcaaggc

SEQ ID NO: 2330 - DNA, 495 bp, Artificial Sequence
  Synthetic Template Oligonucleotide for IgH VJ Locus
gcctccctcgcgccatcagtaggagacaggcttgacagaaatgcagcaaaacccttcagagttaaagcaggagagaggttgtgaggactcacctgaggagacggtgaccagggttccctggccccagtagtcaaagtcgactaggagacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcactaggagacaggcttgactgagcgggctggcaaggc

SEQ ID NO: 2331 - DNA, 495 bp, Artificial Sequence
  Synthetic Template Oligonucleotide for IgH VJ Locus
gcctccctcgcgccatcagtaggagacacacacgtcagaaatgcagcaaaacccttcagagttaaagcaggagagaggttgtgaggactcacctgaggagacggtgaccagggttccctggccccagtagtcaaagtcgactaggagacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcattaggagacacacacgtctgagcgggctggcaaggc

SEQ ID NO: 2332 - DNA, 495 bp, Artificial Sequence
  Synthetic Template Oligonucleotide for IgH VJ Locus
gcctccctcgcgccatcagtaggagactagacggacagaaatgcagcaaaacccttcagagttaaagcaggagagaggttgtgaggactcacctgaggagacggtgaccagggttccctggccccagtagtcaaagtcgactaggagactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgataggagactagacggactgagcgggctggcaaggc

SEQ ID NO: 2333 - DNA, 495 bp, Artificial Sequence
  Synthetic Template Oligonucleotide for IgH VJ Locus
gcctccctcgcgccatcagtaggagacgagcgatacagaaatgcagcaaaacccttcagagttaaagcaggagagaggttgtgaggactcacctgaggagacggtgaccagggttccctggccccagtagtcaaagtcgactaggagacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggtttttaggagacgagcgatactgagcgggctggcaaggc

SEQ ID NO: 2334 - DNA, 495 bp, Artificial Sequence
  Synthetic Template Oligonucleotide for IgH VJ Locus
gcctccctcgcgccatcagtaggagacgcatctgacagaaatgcagcaaaacccttcagagttaaagcaggagagaggttgtgaggactcacctgaggagacggtgaccagggttccctggccccagtagtcaaagtcgactaggagacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacataggagacgcatctgactgagcgggctggcaaggc

SEQ ID NO: 2335 - DNA, 495 bp, Artificial Sequence
  Synthetic Template Oligonucleotide for IgH VJ Locus
gcctccctcgcgccatcagtaggagactgctacaccagaaatgcagcaaaacccttcagagttaaagcaggagagaggttgtgaggactcacctgaggagacggtgaccagggttccctggccccagtagtcaaagtcgactaggagactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgtaggagactgctacacctgagcgggctggcaaggc

SEQ ID NO: 2336 - DNA, 495 bp, Artificial Sequence
  Synthetic Template Oligonucleotide for IgH VJ Locus
gcctccctcgcgccatcagtaggagacaactgccacagaaatgcagcaaaacccttcagagttaaagcaggagagaggttgtgaggactcacctgaggagacggtgaccagggttccctggccccagtagtcaaagtcgactaggagacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggactttaggagacaactgccactgagcgggctggcaaggc

SEQ ID NO: 2337 - DNA, 495 bp, Artificial Sequence
  Synthetic Template Oligonucleotide for IgH VJ Locus
gcctccctcgcgccatcagtaggagacttggactgcagaaatgcagcaaaacccttcagagttaaagcaggagagaggttgtgaggactcacctgaggagacggtgaccagggttccctggccccagtagtcaaagtcgactaggagacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggtaggagacttggactgctgagcgggctggcaaggc

SEQ ID NO: 2338 - DNA, 495 bp, Artificial Sequence
  Synthetic Template Oligonucleotide for IgH VJ Locus
gcctccctcgcgccatcagtaggagactcggtactcagaaatgcagcaaaacccttcagagttaaagcaggagagaggttgtgaggactcacctgaggagacggtgaccagggttccctggccccagtagtcaaagtcgactaggagactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgtaggagactcggtactctgagcgggctggcaaggc

SEQ ID NO: 2339 - DNA, 495 bp, Artificial Sequence
  Synthetic Template Oligonucleotide for IgH VJ Locus
gcctccctcgcgccatcagtaggagacccatggatcagaaatgcagcaaaacccttcagagttaaagcaggagagaggttgtgaggactcacctgaggagacggtgaccagggttccctggccccagtagtcaaagtcgactaggagacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatactaggagacccatggatctgagcgggctggcaaggc

SEQ ID NO: 2340 - DNA, 495 bp, Artificial Sequence
  Synthetic Template Oligonucleotide for IgH VJ Locus
gcctccctcgcgccatcagtaggagacacgaagatcagaaatgcagcaaaacccttcagagttaaagcaggagagaggttgtgaggactcacctgaggagacggtgaccagggttccctggccccagtagtcaaagtcgactaggagacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaataggagacacgaagatctgagcgggctggcaaggc

SEQ ID NO: 2341 - DNA, 495 bp, Artificial Sequence
  Synthetic Template Oligonucleotide for IgH VJ Locus
gcctccctcgcgccatcagtaggagacactgtggacagaaatgcagcaaaacccttcagagttaaagcaggagagaggttgtgaggactcacctgaggagacggtgaccagggttccctggccccagtagtcaaagtcgactaggagacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggactttaggagacactgtggactgagcgggctggcaaggc

SEQ ID NO: 2342 - DNA, 495 bp, Artificial Sequence
  Synthetic Template Oligonucleotide for IgH VJ Locus
gcctccctcgcgccatcagtaggagacggtgtcatcagaaatgcagcaaaacccttcagagttaaagcaggagagaggttgtgaggactcacctgaggagacggtgaccagggttccctggccccagtagtcaaagtcgactaggagacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactcttaggagacggtgtcatctgagcgggctggcaaggc

SEQ ID NO: 2343 - DNA, 495 bp, Artificial Sequence
  Synthetic Template Oligonucleotide for IgH VJ Locus
gcctccctcgcgccatcagtaggagactcgtgaagcagaaatgcagcaaaacccttcagagttaaagcaggagagaggttgtgaggactcacctgaggagacggtgaccagggttccctggccccagtagtcaaagtcgactaggagactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggtaggagactcgtgaagctgagcgggctggcaaggc

SEQ ID NO: 2344 - DNA, 495 bp, Artificial Sequence
  Synthetic Template Oligonucleotide for IgH VJ Locus
gcctccctcgcgccatcagtaggagaccactagctcagaaatgcagcaaaacccttcagagttaaagcaggagagaggttgtgaggactcacctgaggagacggtgaccagggttccctggccccagtagtcaaagtcgactaggagaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaataggagaccactagctctgagcgggctggcaaggc

SEQ ID NO: 2345 - DNA, 495 bp, Artificial Sequence
  Synthetic Template Oligonucleotide for IgH VJ Locus
gcctccctcgcgccatcagtaggagacggtcaactcagaaatgcagcaaaacccttcagagttaaagcaggagagaggttgtgaggactcacctgaggagacggtgaccagggttccctggccccagtagtcaaagtcgactaggagacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggataggagacggtcaactctgagcgggctggcaaggc

SEQ ID NO: 2346 - DNA, 495 bp, Artificial Sequence
  Synthetic Template Oligonucleotide for IgH VJ Locus
gcctccctcgcgccatcagtaggagactacgtacgcagaaatgcagcaaaacccttcagagttaaagcaggagagaggttgtgaggactcacctgaggagacggtgaccagggttccctggccccagtagtcaaagtcgactaggagactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatctaggagactacgtacgctgagcgggctggcaaggc

SEQ ID NO: 2347 - DNA, 495 bp, Artificial Sequence
  Synthetic Template Oligonucleotide for IgH VJ Locus
gcctccctcgcgccatcagtaggagacatgacacccagaaatgcagcaaaacccttcagagttaaagcaggagagaggttgtgaggactcacctgaggagacggtgaccagggttccctggccccagtagtcaaagtcgactaggagacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggtaggagacatgacaccctgagcgggctggcaaggc

SEQ ID NO: 2348 - DNA, 495 bp, Artificial Sequence
  Synthetic Template Oligonucleotide for IgH VJ Locus
gcctccctcgcgccatcagtaggagaccttcacgacagaaatgcagcaaaacccttcagagttaaagcaggagagaggttgtgaggactcacctgaggagacggtgaccagggttccctggccccagtagtcaaagtcgactaggagaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacactaggagaccttcacgactgagcgggctggcaaggc

SEQ ID NO: 2349 - DNA, 495 bp, Artificial Sequence
  Synthetic Template Oligonucleotide for IgH VJ Locus
gcctccctcgcgccatcagtaggagacagaatcagcagaaatgcagcaaaacccttcagagttaaagcaggagagaggttgtgaggactcacctgaggagacggtgaccagggttccctggccccagtagtcaaagtcgactaggagacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacacctaggagacagaatcagctgagcgggctggcaaggc

SEQ ID NO: 2350 - DNA, 495 bp, Artificial Sequence
  Synthetic Template Oligonucleotide for IgH VJ Locus
gcctccctcgcgccatcagtaggagacagttatgccagaaatgcagcaaaacccttcagagttaaagcaggagagaggttgtgaggactcacctgaggagacggtgaccagggttccctggccccagtagtcaaagtcgactaggagacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataataggagacagttatgcctgagcgggctggcaaggc

SEQ ID NO: 2351 - DNA, 495 bp, Artificial Sequence
  Synthetic Template Oligonucleotide for IgH VJ Locus
gcctccctcgcgccatcagtaggagacaggtctcacagaaatgcagcaaaacccttcagagttaaagcaggagagaggttgtgaggactcacctgaggagacggtgaccagggttccctggccccagtagtcaaagtcgactaggagacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacctaggagacaggtctcactgagcgggctggcaaggc

SEQ ID NO: 2352 - DNA, 495 bp, Artificial Sequence
  Synthetic Template Oligonucleotide for IgH VJ Locus
gcctccctcgcgccatcagtaggagacgtcatagtcagaaatgcagcaaaacccttcagagttaaagcaggagagaggttgtgaggactcacctgaggagacggtgaccagggttccctggccccagtagtcaaagtcgactaggagacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggttaggagacgtcatagtctgagcgggctggcaaggc

SEQ ID NO: 2353 - DNA, 495 bp, Artificial Sequence
  Synthetic Template Oligonucleotide for IgH VJ Locus
gcctccctcgcgccatcagtaggagacgtgacttgcagaaatgcagcaaaacccttcagagttaaagcaggagagaggttgtgaggactcacctgaggagacggtgaccagggttccctggccccagtagtcaaagtcgactaggagacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgtaggagacgtgacttgctgagcgggctggcaaggc

SEQ ID NO: 2354 - DNA, 495 bp, Artificial Sequence
  Synthetic Template Oligonucleotide for IgH VJ Locus
gcctccctcgcgccatcagtaggagacgattgcagcagaaatgcagcaaaacccttcagagttaaagcaggagagaggttgtgaggactcacctgaggagacggtgaccagggttccctggccccagtagtcaaagtcgactaggagacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacctaggagacgattgcagctgagcgggctggcaaggc

SEQ ID NO: 2355 - DNA, 495 bp, Artificial Sequence
  Synthetic Template Oligonucleotide for IgH VJ Locus
gcctccctcgcgccatcagtaggagacactatgaccagaaatgcagcaaaacccttcagagttaaagcaggagagaggttgtgaggactcacctgaggagacggtgaccagggttccctggccccagtagtcaaagtcgactaggagacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaactaggagacactatgacctgagcgggctggcaaggc

SEQ ID NO: 2356 - DNA, 495 bp, Artificial Sequence
  Synthetic Template Oligonucleotide for IgH VJ Locus
gcctccctcgcgccatcagtaggagacatggtcaacagaaatgcagcaaaacccttcagagttaaagcaggagagaggttgtgaggactcacctgaggagacggtgaccagggttccctggccccagtagtcaaagtcgactaggagacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagactaggagacatggtcaactgagcgggctggcaaggc

SEQ ID NO: 2357 - DNA, 495 bp, Artificial Sequence
  Synthetic Template Oligonucleotide for IgH VJ Locus
gcctccctcgcgccatcagtaggagacgatggcttcagaaatgcagcaaaacccttcagagttaaagcaggagagaggttgtgaggactcacctgaggagacggtgaccagggttccctggccccagtagtcaaagtcgactaggagacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaactaggagacgatggcttctgagcgggctggcaaggc

SEQ ID NO: 2358 - DNA, 495 bp, Artificial Sequence
  Synthetic Template Oligonucleotide for IgH VJ Locus
gcctccctcgcgccatcagtaggagacagcatatgcagaaatgcagcaaaacccttcagagttaaagcaggagagaggttgtgaggactcacctgaggagacggtgaccagggttccctggccccagtagtcaaagtcgactaggagacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagactaggagacagcatatgctgagcgggctggcaaggc

SEQ ID NO: 2359 - DNA, 495 bp, Artificial Sequence
  Synthetic Template Oligonucleotide for IgH VJ Locus
gcctccctcgcgccatcagtaggagaccatatgctcagaaatgcagcaaaacccttcagagttaaagcaggagagaggttgtgaggactcacctgaggagacggtgaccagggttccctggccccagtagtcaaagtcgactaggagaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgtaggagaccatatgctctgagcgggctggcaaggc

SEQ ID NO: 2360 - DNA, 495 bp, Artificial Sequence
  Synthetic Template Oligonucleotide for IgH VJ Locus
gcctccctcgcgccatcagtaggagactcgtcgatcagaaatgcagcaaaacccttcagagttaaagcaggagagaggttgtgaggactcacctgaggagacggtgaccagggttccctggccccagtagtcaaagtcgactaggagactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacacctaggagactcgtcgatctgagcgggctggcaaggc

SEQ ID NO: 2361 - DNA, 495 bp, Artificial Sequence
  Synthetic Template Oligonucleotide for IgH VJ Locus
gcctccctcgcgccatcagtaggagaccagtctgtcagaaatgcagcaaaacccttcagagttaaagcaggagagaggttgtgaggactcacctgaggagacggtgaccagggttccctggccccagtagtcaaagtcgactaggagaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgctaggagaccagtctgtctgagcgggctggcaaggc

SEQ ID NO: 2362 - DNA, 495 bp, Artificial Sequence
  Synthetic Template Oligonucleotide for IgH VJ Locus
gcctccctcgcgccatcagtaggagacaacgcgtacagaaatgcagcaaaacccttcagagttaaagcaggagagaggttgtgaggactcacctgaggagacggtgaccagggttccctggccccagtagtcaaagtcgactaggagacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgtaggagacaacgcgtactgagcgggctggcaaggc

SEQ ID NO: 2363 - DNA, 495 bp, Artificial Sequence
  Synthetic Template Oligonucleotide for IgH VJ Locus
gcctccctcgcgccatcagtaggagacgtagttcgcagaaatgcagcaaaacccttcagagttaaagcaggagagaggttgtgaggactcacctgaggagacggtgaccagggttccctggccccagtagtcaaagtcgactaggagacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgctaggagacgtagttcgctgagcgggctggcaaggc

SEQ ID NO: 2364 - DNA, 495 bp, Artificial Sequence
  Synthetic Template Oligonucleotide for IgH VJ Locus
gcctccctcgcgccatcagtaggagaccgaactaccagaaatgcagcaaaacccttcagagttaaagcaggagagaggttgtgaggactcacctgaggagacggtgaccagggttccctggccccagtagtcaaagtcgactaggagaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagactaggagaccgaactacctgagcgggctggcaaggc

SEQ ID NO: 2365 - DNA, 495 bp, Artificial Sequence
  Synthetic Template Oligonucleotide for IgH VJ Locus
gcctccctcgcgccatcagtaggagacttaacgtccagaaatgcagcaaaacccttcagagttaaagcaggagagaggttgtgaggactcacctgaggagacggtgaccagggttccctggccccagtagtcaaagtcgactaggagacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacacctaggagacttaacgtcctgagcgggctggcaaggc

SEQ ID NO: 2366 - DNA, 495 bp, Artificial Sequence
  Synthetic Template Oligonucleotide for IgH VJ Locus
gcctccctcgcgccatcagtaggagacagcaacctcagaaatgcagcaaaacccttcagagttaaagcaggagagaggttgtgaggactcacctgaggagacggtgaccagggttccctggccccagtagtcaaagtcgactaggagacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggactaggagacagcaacctctgagcgggctggcaaggc

SEQ ID NO: 2367 - DNA, 495 bp, Artificial Sequence
  Synthetic Template Oligonucleotide for IgH VJ Locus
gcctccctcgcgccatcagtaggagacttctcgagcagaaatgcagcaaaacccttcagagttaaagcaggagagaggttgtgaggactcacctgaggagacggtgaccagggttccctggccccagtagtcaaagtcgactaggagacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggactttaggagacttctcgagctgagcgggctggcaaggc

SEQ ID NO: 2368 - DNA, 495 bp, Artificial Sequence
  Synthetic Template Oligonucleotide for IgH VJ Locus
gcctccctcgcgccatcagtaggagacactctacgcagaaatgcagcaaaacccttcagagttaaagcaggagagaggttgtgaggactcacctgaggagacggtgaccagggttccctggccccagtagtcaaagtcgactaggagacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggactaggagacactctacgctgagcgggctggcaaggc

SEQ ID NO: 2369 - DNA, 495 bp, Artificial Sequence
  Synthetic Template Oligonucleotide for IgH VJ Locus
gcctccctcgcgccatcagtaggagactaccggaacagaaatgcagcaaaacccttcagagttaaagcaggagagaggttgtgaggactcacctgaggagacggtgaccagggttccctggccccagtagtcaaagtcgactaggagactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacacctaggagactaccggaactgagcgggctggcaaggc

SEQ ID NO: 2370 - DNA, 495 bp, Artificial Sequence
  Synthetic Template Oligonucleotide for IgH VJ Locus
gcctccctcgcgccatcagtaggagaccgaattgccagaaatgcagcaaaacccttcagagttaaagcaggagagaggttgtgaggactcacctgaggagacggtgaccagggttccctggccccagtagtcaaagtcgactaggagaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaactaggagaccgaattgcctgagcgggctggcaaggc

SEQ ID NO: 2371 - DNA, 495 bp, Artificial Sequence
  Synthetic Template Oligonucleotide for IgH VJ Locus
gcctccctcgcgccatcagtaggagacttcgctcacagaaatgcagcaaaacccttcagagttaaagcaggagagaggttgtgaggactcacctgaggagacggtgaccagggttccctggccccagtagtcaaagtcgactaggagacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacataggagacttcgctcactgagcgggctggcaaggc

SEQ ID NO: 2372 - DNA, 495 bp, Artificial Sequence
  Synthetic Template Oligonucleotide for IgH VJ Locus
gcctccctcgcgccatcagtaggagacgacgttaacagaaatgcagcaaaacccttcagagttaaagcaggagagaggttgtgaggactcacctgaggagacggtgaccagggttccctggccccagtagtcaaagtcgactaggagacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgtaggagacgacgttaactgagcgggctggcaaggc

SEQ ID NO: 2373 - DNA, 495 bp, Artificial Sequence
  Synthetic Template Oligonucleotide for IgH VJ Locus
gcctccctcgcgccatcagtaggagaccgtagagtcagaaatgcagcaaaacccttcagagttaaagcaggagagaggttgtgaggactcacctgaggagacggtgaccagggttccctggccccagtagtcaaagtcgactaggagaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgctaggagaccgtagagtctgagcgggctggcaaggc

SEQ ID NO: 2374 - DNA, 495 bp, Artificial Sequence
  Synthetic Template Oligonucleotide for IgH VJ Locus
gcctccctcgcgccatcagtaggagacttccggtacagaaatgcagcaaaacccttcagagttaaagcaggagagaggttgtgaggactcacctgaggagacggtgaccagggttccctggccccagtagtcaaagtcgactaggagacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgctaggagacttccggtactgagcgggctggcaaggc

SEQ ID NO: 2375 - DNA, 495 bp, Artificial Sequence
  Synthetic Template Oligonucleotide for IgH VJ Locus
gcctccctcgcgccatcagtaggagacgcaattcgcagaaatgcagcaaaacccttcagagttaaagcaggagagaggttgtgaggactcacctgaggagacggtgaccagggttccctggccccagtagtcaaagtcgactaggagacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacactaggagacgcaattcgctgagcgggctggcaaggc

SEQ ID NO: 2376 - DNA, 495 bp, Artificial Sequence
  Synthetic Template Oligonucleotide for IgH VJ Locus
gcctccctcgcgccatcagtaggagactgagcgaacagaaatgcagcaaaacccttcagagttaaagcaggagagaggttgtgaggactcacctgaggagacggtgaccagggttccctggccccagtagtcaaagtcgactaggagactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgctaggagactgagcgaactgagcgggctggcaaggc

SEQ ID NO: 2377 - DNA, 495 bp, Artificial Sequence
  Synthetic Template Oligonucleotide for IgH VJ Locus
gcctccctcgcgccatcagtaggagactactaagccagaaatgcagcaaaacccttcagagttaaagcaggagagaggttgtgaggactcacctgaggagacggtgaccagggttccctggccccagtagtcaaagtcgactaggagactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggacccctaggagactactaagcctgagcgggctggcaaggc

SEQ ID NO: 2378 - DNA, 495 bp, Artificial Sequence
  Synthetic Template Oligonucleotide for IgH VJ Locus
gcctccctcgcgccatcagtaggagactggcgtatcagaaatgcagcaaaacccttcagagttaaagcaggagagaggttgtgaggactcacctgaggagacggtgaccagggttccctggccccagtagtcaaagtcgactaggagactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgttaggagactggcgtatctgagcgggctggcaaggc

SEQ ID NO: 2379 - DNA, 495 bp, Artificial Sequence
  Synthetic Template Oligonucleotide for IgH VJ Locus
gcctccctcgcgccatcagtaggagacgataaccacagaaatgcagcaaaacccttcagagttaaagcaggagagaggttgtgaggactcacctgaggagacggtgaccagggttccctggccccagtagtcaaagtcgactaggagacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgtaggagacgataaccactgagcgggctggcaaggc

SEQ ID NO: 2380 - DNA, 495 bp, Artificial Sequence
  Synthetic Template Oligonucleotide for IgH VJ Locus
gcctccctcgcgccatcagtaggagacctagtgaacagaaatgcagcaaaacccttcagagttaaagcaggagagaggttgtgaggactcacctgaggagacggtgaccagggttccctggccccagtagtcaaagtcgactaggagacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagtaggagacctagtgaactgagcgggctggcaaggc

SEQ ID NO: 2381 - DNA, 495 bp, Artificial Sequence
  Synthetic Template Oligonucleotide for IgH VJ Locus
gcctccctcgcgccatcagtaggagacacgttcaccagaaatgcagcaaaacccttcagagttaaagcaggagagaggttgtgaggactcacctgaggagacggtgaccagggttccctggccccagtagtcaaagtcgactaggagacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgttaggagacacgttcacctgagcgggctggcaaggc

SEQ ID NO: 2382 - DNA, 448 bp, Artificial Sequence
  Synthetic Template Oligonucleotide for IgH VJ Locus
gcctccctcgcgccatcagtaggagacattacgctcagaaatgcagcaaaacccttcagagttaaagcaggagagaggttgtgaggactcacctgaggagacggtgaccagggttccctggccccagtagtcaaagtcgactaggagacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcataggagacattacgctctgagcgggctggcaaggc

SEQ ID NO: 2383 - DNA, 495 bp, Artificial Sequence
  Synthetic Template Oligonucleotide for IgH VJ Locus
gcctccctcgcgccatcagtaggagaccattgagtcagaaatgcagcaaaacccttcagagttaaagcaggagagaggttgtgaggactcacctgaggagacggtgaccagggttccctggccccagtagtcaaagtcgactaggagaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcacctaggagaccattgagtctgagcgggctggcaaggc

SEQ ID NO: 2384 - DNA, 495 bp, Artificial Sequence
  Synthetic Template Oligonucleotide for IgH VJ Locus
gcctccctcgcgccatcaggacactctcttggttactggcaagctgagtctccctaagtggactcagagagggggtggtgaggactcacctgaggagacggtgaccagggttccctggccccaggggtcgaaccagtcgacgacactctcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgacactctcttggttactgagcgggctggcaaggc

SEQ ID NO: 2385 - DNA, 495 bp, Artificial Sequence
  Synthetic Template Oligonucleotide for IgH VJ Locus
gcctccctcgcgccatcaggacactctacctcttgctggcaagctgagtctccctaagtggactcagagagggggtggtgaggactcacctgaggagacggtgaccagggttccctggccccaggggtcgaaccagtcgacgacactctacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgacactctacctcttgctgagcgggctggcaaggc

SEQ ID NO: 2386 - DNA, 495 bp, Artificial Sequence
  Synthetic Template Oligonucleotide for IgH VJ Locus
gcctccctcgcgccatcaggacactctctgattctctggcaagctgagtctccctaagtggactcagagagggggtggtgaggactcacctgaggagacggtgaccagggttccctggccccaggggtcgaaccagtcgacgacactctctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgacactctctgattctctgagcgggctggcaaggc

SEQ ID NO: 2387 - DNA, 495 bp, Artificial Sequence
  Synthetic Template Oligonucleotide for IgH VJ Locus
gcctccctcgcgccatcaggacactctagtaccgactggcaagctgagtctccctaagtggactcagagagggggtggtgaggactcacctgaggagacggtgaccagggttccctggccccaggggtcgaaccagtcgacgacactctagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgacactctagtaccgactgagcgggctggcaaggc

SEQ ID NO: 2388 - DNA, 495 bp, Artificial Sequence
  Synthetic Template Oligonucleotide for IgH VJ Locus
gcctccctcgcgccatcaggacactctatccatggctggcaagctgagtctccctaagtggactcagagagggggtggtgaggactcacctgaggagacggtgaccagggttccctggccccaggggtcgaaccagtcgacgacactctatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgacactctatccatggctgagcgggctggcaaggc

SEQ ID NO: 2389 - DNA, 495 bp, Artificial Sequence
  Synthetic Template Oligonucleotide for IgH VJ Locus
gcctccctcgcgccatcaggacactctgtagcagtctggcaagctgagtctccctaagtggactcagagagggggtggtgaggactcacctgaggagacggtgaccagggttccctggccccaggggtcgaaccagtcgacgacactctgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgacactctgtagcagtctgagcgggctggcaaggc

SEQ ID NO: 2390 - DNA, 495 bp, Artificial Sequence
  Synthetic Template Oligonucleotide for IgH VJ Locus
gcctccctcgcgccatcaggacactctatcttcgtctggcaagctgagtctccctaagtggactcagagagggggtggtgaggactcacctgaggagacggtgaccagggttccctggccccaggggtcgaaccagtcgacgacactctatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgacactctatcttcgtctgagcgggctggcaaggc

SEQ ID NO: 2391 - DNA, 495 bp, Artificial Sequence
  Synthetic Template Oligonucleotide for IgH VJ Locus
gcctccctcgcgccatcaggacactcttccacagtctggcaagctgagtctccctaagtggactcagagagggggtggtgaggactcacctgaggagacggtgaccagggttccctggccccaggggtcgaaccagtcgacgacactcttccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgacactcttccacagtctgagcgggctggcaaggc

SEQ ID NO: 2392 - DNA, 495 bp, Artificial Sequence
  Synthetic Template Oligonucleotide for IgH VJ Locus
gcctccctcgcgccatcaggacactctagctagtgctggcaagctgagtctccctaagtggactcagagagggggtggtgaggactcacctgaggagacggtgaccagggttccctggccccaggggtcgaaccagtcgacgacactctagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgacactctagctagtgctgagcgggctggcaaggc

SEQ ID NO: 2393 - DNA, 495 bp, Artificial Sequence
  Synthetic Template Oligonucleotide for IgH VJ Locus
gcctccctcgcgccatcaggacactcttaaccaagctggcaagctgagtctccctaagtggactcagagagggggtggtgaggactcacctgaggagacggtgaccagggttccctggccccaggggtcgaaccagtcgacgacactcttaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgacactcttaaccaagctgagcgggctggcaaggc

SEQ ID NO: 2394 - DNA, 495 bp, Artificial Sequence
  Synthetic Template Oligonucleotide for IgH VJ Locus
gcctccctcgcgccatcaggacactctcaagaggtctggcaagctgagtctccctaagtggactcagagagggggtggtgaggactcacctgaggagacggtgaccagggttccctggccccaggggtcgaaccagtcgacgacactctcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgacactctcaagaggtctgagcgggctggcaaggc

SEQ ID NO: 2395 - DNA, 495 bp, Artificial Sequence
  Synthetic Template Oligonucleotide for IgH VJ Locus
gcctccctcgcgccatcaggacactctagttgaccctggcaagctgagtctccctaagtggactcagagagggggtggtgaggactcacctgaggagacggtgaccagggttccctggccccaggggtcgaaccagtcgacgacactctagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagacactctagttgaccctgagcgggctggcaaggc

SEQ ID NO: 2396 - DNA, 495 bp, Artificial Sequence
  Synthetic Template Oligonucleotide for IgH VJ Locus
gcctccctcgcgccatcaggacactctcagcatatctggcaagctgagtctccctaagtggactcagagagggggtggtgaggactcacctgaggagacggtgaccagggttccctggccccaggggtcgaaccagtcgacgacactctcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagacactctcagcatatctgagcgggctggcaaggc

SEQ ID NO: 2397 - DNA, 495 bp, Artificial Sequence
  Synthetic Template Oligonucleotide for IgH VJ Locus
gcctccctcgcgccatcaggacactctgcaggattctggcaagctgagtctccctaagtggactcagagagggggtggtgaggactcacctgaggagacggtgaccagggttccctggccccaggggtcgaaccagtcgacgacactctgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagacactctgcaggattctgagcgggctggcaaggc

SEQ ID NO: 2398 - DNA, 495 bp, Artificial Sequence
  Synthetic Template Oligonucleotide for IgH VJ Locus
gcctccctcgcgccatcaggacactctgtccattcctggcaagctgagtctccctaagtggactcagagagggggtggtgaggactcacctgaggagacggtgaccagggttccctggccccaggggtcgaaccagtcgacgacactctgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgacactctgtccattcctgagcgggctggcaaggc

SEQ ID NO: 2399 - DNA, 495 bp, Artificial Sequence
  Synthetic Template Oligonucleotide for IgH VJ Locus
gcctccctcgcgccatcaggacactctgcataactctggcaagctgagtctccctaagtggactcagagagggggtggtgaggactcacctgaggagacggtgaccagggttccctggccccaggggtcgaaccagtcgacgacactctgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgacactctgcataactctgagcgggctggcaaggc

SEQ ID NO: 2400 - DNA, 495 bp, Artificial Sequence
  Synthetic Template Oligonucleotide for IgH VJ Locus
gcctccctcgcgccatcaggacactctatatgctgctggcaagctgagtctccctaagtggactcagagagggggtggtgaggactcacctgaggagacggtgaccagggttccctggccccaggggtcgaaccagtcgacgacactctatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgacactctatatgctgctgagcgggctggcaaggc

SEQ ID NO: 2401 - DNA, 495 bp, Artificial Sequence
  Synthetic Template Oligonucleotide for IgH VJ Locus
gcctccctcgcgccatcaggacactctaatcctgcctggcaagctgagtctccctaagtggactcagagagggggtggtgaggactcacctgaggagacggtgaccagggttccctggccccaggggtcgaaccagtcgacgacactctaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgacactctaatcctgcctgagcgggctggcaaggc

SEQ ID NO: 2402 - DNA, 495 bp, Artificial Sequence
  Synthetic Template Oligonucleotide for IgH VJ Locus
gcctccctcgcgccatcaggacactcttgagacctctggcaagctgagtctccctaagtggactcagagagggggtggtgaggactcacctgaggagacggtgaccagggttccctggccccaggggtcgaaccagtcgacgacactcttgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggacactcttgagacctctgagcgggctggcaaggc

SEQ ID NO: 2403 - DNA, 495 bp, Artificial Sequence
  Synthetic Template Oligonucleotide for IgH VJ Locus
gcctccctcgcgccatcaggacactctgaatggacctggcaagctgagtctccctaagtggactcagagagggggtggtgaggactcacctgaggagacggtgaccagggttccctggccccaggggtcgaaccagtcgacgacactctgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgacactctgaatggacctgagcgggctggcaaggc

SEQ ID NO: 2404 - DNA, 495 bp, Artificial Sequence
  Synthetic Template Oligonucleotide for IgH VJ Locus
gcctccctcgcgccatcaggacactctcacatggactggcaagctgagtctccctaagtggactcagagagggggtggtgaggactcacctgaggagacggtgaccagggttccctggccccaggggtcgaaccagtcgacgacactctcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgacactctcacatggactgagcgggctggcaaggc

SEQ ID NO: 2405 - DNA, 495 bp, Artificial Sequence
  Synthetic Template Oligonucleotide for IgH VJ Locus
gcctccctcgcgccatcaggacactctttgaccatctggcaagctgagtctccctaagtggactcagagagggggtggtgaggactcacctgaggagacggtgaccagggttccctggccccaggggtcgaaccagtcgacgacactctttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgacactctttgaccatctgagcgggctggcaaggc

SEQ ID NO: 2406 - DNA, 495 bp, Artificial Sequence
  Synthetic Template Oligonucleotide for IgH VJ Locus
gcctccctcgcgccatcaggacactctaagccatcctggcaagctgagtctccctaagtggactcagagagggggtggtgaggactcacctgaggagacggtgaccagggttccctggccccaggggtcgaaccagtcgacgacactctaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgacactctaagccatcctgagcgggctggcaaggc

SEQ ID NO: 2407 - DNA, 495 bp, Artificial Sequence
  Synthetic Template Oligonucleotide for IgH VJ Locus
gcctccctcgcgccatcaggacactcttccatgtgctggcaagctgagtctccctaagtggactcagagagggggtggtgaggactcacctgaggagacggtgaccagggttccctggccccaggggtcgaaccagtcgacgacactcttccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgacactcttccatgtgctgagcgggctggcaaggc

SEQ ID NO: 2408 - DNA, 495 bp, Artificial Sequence
  Synthetic Template Oligonucleotide for IgH VJ Locus
gcctccctcgcgccatcaggacactctcaagtcacctggcaagctgagtctccctaagtggactcagagagggggtggtgaggactcacctgaggagacggtgaccagggttccctggccccaggggtcgaaccagtcgacgacactctcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgacactctcaagtcacctgagcgggctggcaaggc

SEQ ID NO: 2409 - DNA, 495 bp, Artificial Sequence
  Synthetic Template Oligonucleotide for IgH VJ Locus
gcctccctcgcgccatcaggacactctctgcaatcctggcaagctgagtctccctaagtggactcagagagggggtggtgaggactcacctgaggagacggtgaccagggttccctggccccaggggtcgaaccagtcgacgacactctctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgacactctctgcaatcctgagcgggctggcaaggc

SEQ ID NO: 2410 - DNA, 495 bp, Artificial Sequence
  Synthetic Template Oligonucleotide for IgH VJ Locus
gcctccctcgcgccatcaggacactctatcgacgactggcaagctgagtctccctaagtggactcagagagggggtggtgaggactcacctgaggagacggtgaccagggttccctggccccaggggtcgaaccagtcgacgacactctatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgacactctatcgacgactgagcgggctggcaaggc

SEQ ID NO: 2411 - DNA, 495 bp, Artificial Sequence
  Synthetic Template Oligonucleotide for IgH VJ Locus
gcctccctcgcgccatcaggacactctacagactgctggcaagctgagtctccctaagtggactcagagagggggtggtgaggactcacctgaggagacggtgaccagggttccctggccccaggggtcgaaccagtcgacgacactctacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagacactctacagactgctgagcgggctggcaaggc

SEQ ID NO: 2412 - DNA, 495 bp, Artificial Sequence
  Synthetic Template Oligonucleotide for IgH VJ Locus
gcctccctcgcgccatcaggacactctccttatagctggcaagctgagtctccctaagtggactcagagagggggtggtgaggactcacctgaggagacggtgaccagggttccctggccccaggggtcgaaccagtcgacgacactctccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgacactctccttatagctgagcgggctggcaaggc

SEQ ID NO: 2413 - DNA, 495 bp, Artificial Sequence
  Synthetic Template Oligonucleotide for IgH VJ Locus
gcctccctcgcgccatcaggacactcttacgcgttctggcaagctgagtctccctaagtggactcagagagggggtggtgaggactcacctgaggagacggtgaccagggttccctggccccaggggtcgaaccagtcgacgacactcttacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgacactcttacgcgttctgagcgggctggcaaggc

SEQ ID NO: 2414 - DNA, 495 bp, Artificial Sequence
  Synthetic Template Oligonucleotide for IgH VJ Locus
gcctccctcgcgccatcaggacactctctataaggctggcaagctgagtctccctaagtggactcagagagggggtggtgaggactcacctgaggagacggtgaccagggttccctggccccaggggtcgaaccagtcgacgacactctctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggacactctctataaggctgagcgggctggcaaggc

SEQ ID NO: 2415 - DNA, 495 bp, Artificial Sequence
  Synthetic Template Oligonucleotide for IgH VJ Locus
gcctccctcgcgccatcaggacactcttcttagtcctggcaagctgagtctccctaagtggactcagagagggggtggtgaggactcacctgaggagacggtgaccagggttccctggccccaggggtcgaaccagtcgacgacactcttcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgacactcttcttagtcctgagcgggctggcaaggc

SEQ ID NO: 2416 - DNA, 495 bp, Artificial Sequence
  Synthetic Template Oligonucleotide for IgH VJ Locus
gcctccctcgcgccatcaggacactcttgtctgcactggcaagctgagtctccctaagtggactcagagagggggtggtgaggactcacctgaggagacggtgaccagggttccctggccccaggggtcgaaccagtcgacgacactcttgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgacactcttgtctgcactgagcgggctggcaaggc

SEQ ID NO: 2417 - DNA, 495 bp, Artificial Sequence
  Synthetic Template Oligonucleotide for IgH VJ Locus
gcctccctcgcgccatcaggacactctgccattaactggcaagctgagtctccctaagtggactcagagagggggtggtgaggactcacctgaggagacggtgaccagggttccctggccccaggggtcgaaccagtcgacgacactctgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgacactctgccattaactgagcgggctggcaaggc

SEQ ID NO: 2418 - DNA, 495 bp, Artificial Sequence
  Synthetic Template Oligonucleotide for IgH VJ Locus
gcctccctcgcgccatcaggacactctgactaagactggcaagctgagtctccctaagtggactcagagagggggtggtgaggactcacctgaggagacggtgaccagggttccctggccccaggggtcgaaccagtcgacgacactctgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggacactctgactaagactgagcgggctggcaaggc

SEQ ID NO: 2419 - DNA, 495 bp, Artificial Sequence
  Synthetic Template Oligonucleotide for IgH VJ Locus
gcctccctcgcgccatcaggacactctaggttgctctggcaagctgagtctccctaagtggactcagagagggggtggtgaggactcacctgaggagacggtgaccagggttccctggccccaggggtcgaaccagtcgacgacactctaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggacactctaggttgctctgagcgggctggcaaggc

SEQ ID NO: 2420 - DNA, 495 bp, Artificial Sequence
  Synthetic Template Oligonucleotide for IgH VJ Locus
gcctccctcgcgccatcaggacactctctcgagaactggcaagctgagtctccctaagtggactcagagagggggtggtgaggactcacctgaggagacggtgaccagggttccctggccccaggggtcgaaccagtcgacgacactctctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgacactctctcgagaactgagcgggctggcaaggc

SEQ ID NO: 2421 - DNA, 495 bp, Artificial Sequence
  Synthetic Template Oligonucleotide for IgH VJ Locus
gcctccctcgcgccatcaggacactctttaatggcctggcaagctgagtctccctaagtggactcagagagggggtggtgaggactcacctgaggagacggtgaccagggttccctggccccaggggtcgaaccagtcgacgacactctttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgacactctttaatggcctgagcgggctggcaaggc

SEQ ID NO: 2422 - DNA, 495 bp, Artificial Sequence
  Synthetic Template Oligonucleotide for IgH VJ Locus
gcctccctcgcgccatcaggacactcttgcagacactggcaagctgagtctccctaagtggactcagagagggggtggtgaggactcacctgaggagacggtgaccagggttccctggccccaggggtcgaaccagtcgacgacactcttgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagacactcttgcagacactgagcgggctggcaaggc

SEQ ID NO: 2423 - DNA, 495 bp, Artificial Sequence
  Synthetic Template Oligonucleotide for IgH VJ Locus
gcctccctcgcgccatcaggacactcttcactgagctggcaagctgagtctccctaagtggactcagagagggggtggtgaggactcacctgaggagacggtgaccagggttccctggccccaggggtcgaaccagtcgacgacactcttcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgacactcttcactgagctgagcgggctggcaaggc

SEQ ID NO: 2424 - DNA, 495 bp, Artificial Sequence
  Synthetic Template Oligonucleotide for IgH VJ Locus
gcctccctcgcgccatcaggacactctgagtacgtctggcaagctgagtctccctaagtggactcagagagggggtggtgaggactcacctgaggagacggtgaccagggttccctggccccaggggtcgaaccagtcgacgacactctgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgacactctgagtacgtctgagcgggctggcaaggc

SEQ ID NO: 2425 - DNA, 495 bp, Artificial Sequence
  Synthetic Template Oligonucleotide for IgH VJ Locus
gcctccctcgcgccatcaggacactctatacgccactggcaagctgagtctccctaagtggactcagagagggggtggtgaggactcacctgaggagacggtgaccagggttccctggccccaggggtcgaaccagtcgacgacactctatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgacactctatacgccactgagcgggctggcaaggc

SEQ ID NO: 2426 - DNA, 495 bp, Artificial Sequence
  Synthetic Template Oligonucleotide for IgH VJ Locus
gcctccctcgcgccatcaggacactcttcgcatcactggcaagctgagtctccctaagtggactcagagagggggtggtgaggactcacctgaggagacggtgaccagggttccctggccccaggggtcgaaccagtcgacgacactcttcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgacactcttcgcatcactgagcgggctggcaaggc

SEQ ID NO: 2427 - DNA, 495 bp, Artificial Sequence
  Synthetic Template Oligonucleotide for IgH VJ Locus
gcctccctcgcgccatcaggacactctcgcttaatctggcaagctgagtctccctaagtggactcagagagggggtggtgaggactcacctgaggagacggtgaccagggttccctggccccaggggtcgaaccagtcgacgacactctcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgacactctcgcttaatctgagcgggctggcaaggc

SEQ ID NO: 2428 - DNA, 495 bp, Artificial Sequence
  Synthetic Template Oligonucleotide for IgH VJ Locus
gcctccctcgcgccatcaggacactcttggttatcctggcaagctgagtctccctaagtggactcagagagggggtggtgaggactcacctgaggagacggtgaccagggttccctggccccaggggtcgaaccagtcgacgacactcttggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgacactcttggttatcctgagcgggctggcaaggc

SEQ ID NO: 2429 - DNA, 495 bp, Artificial Sequence
  Synthetic Template Oligonucleotide for IgH VJ Locus
gcctccctcgcgccatcaggacactctggattgctctggcaagctgagtctccctaagtggactcagagagggggtggtgaggactcacctgaggagacggtgaccagggttccctggccccaggggtcgaaccagtcgacgacactctggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgacactctggattgctctgagcgggctggcaaggc

SEQ ID NO: 2430 - DNA, 495 bp, Artificial Sequence
  Synthetic Template Oligonucleotide for IgH VJ Locus
gcctccctcgcgccatcaggacactctctcagtgactggcaagctgagtctccctaagtggactcagagagggggtggtgaggactcacctgaggagacggtgaccagggttccctggccccaggggtcgaaccagtcgacgacactctctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgacactctctcagtgactgagcgggctggcaaggc

SEQ ID NO: 2431 - DNA, 495 bp, Artificial Sequence
  Synthetic Template Oligonucleotide for IgH VJ Locus
gcctccctcgcgccatcaggacactctacgtactcctggcaagctgagtctccctaagtggactcagagagggggtggtgaggactcacctgaggagacggtgaccagggttccctggccccaggggtcgaaccagtcgacgacactctacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgacactctacgtactcctgagcgggctggcaaggc

SEQ ID NO: 2432 - DNA, 495 bp, Artificial Sequence
  Synthetic Template Oligonucleotide for IgH VJ Locus
gcctccctcgcgccatcaggacactcttgatgcgactggcaagctgagtctccctaagtggactcagagagggggtggtgaggactcacctgaggagacggtgaccagggttccctggccccaggggtcgaaccagtcgacgacactcttgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgacactcttgatgcgactgagcgggctggcaaggc

SEQ ID NO: 2433 - DNA, 495 bp, Artificial Sequence
  Synthetic Template Oligonucleotide for IgH VJ Locus
gcctccctcgcgccatcaggacactctattaagcgctggcaagctgagtctccctaagtggactcagagagggggtggtgaggactcacctgaggagacggtgaccagggttccctggccccaggggtcgaaccagtcgacgacactctattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgacactctattaagcgctgagcgggctggcaaggc

SEQ ID NO: 2434 - DNA, 495 bp, Artificial Sequence
  Synthetic Template Oligonucleotide for IgH VJ Locus
gcctccctcgcgccatcaggacactctagcaatccctggcaagctgagtctccctaagtggactcagagagggggtggtgaggactcacctgaggagacggtgaccagggttccctggccccaggggtcgaaccagtcgacgacactctagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgacactctagcaatccctgagcgggctggcaaggc

SEQ ID NO: 2435 - DNA, 495 bp, Artificial Sequence
  Synthetic Template Oligonucleotide for IgH VJ Locus
gcctccctcgcgccatcaggacactctgcttagtactggcaagctgagtctccctaagtggactcagagagggggtggtgaggactcacctgaggagacggtgaccagggttccctggccccaggggtcgaaccagtcgacgacactctgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagacactctgcttagtactgagcgggctggcaaggc

SEQ ID NO: 2436 - DNA, 495 bp, Artificial Sequence
  Synthetic Template Oligonucleotide for IgH VJ Locus
gcctccctcgcgccatcaggacactcttgaccttgctggcaagctgagtctccctaagtggactcagagagggggtggtgaggactcacctgaggagacggtgaccagggttccctggccccaggggtcgaaccagtcgacgacactcttgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgacactcttgaccttgctgagcgggctggcaaggc

SEQ ID NO: 2437 - DNA, 495 bp, Artificial Sequence
  Synthetic Template Oligonucleotide for IgH VJ Locus
gcctccctcgcgccatcaggacactctcaaggtcactggcaagctgagtctccctaagtggactcagagagggggtggtgaggactcacctgaggagacggtgaccagggttccctggccccaggggtcgaaccagtcgacgacactctcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgacactctcaaggtcactgagcgggctggcaaggc

SEQ ID NO: 2438 - DNA, 495 bp, Artificial Sequence
  Synthetic Template Oligonucleotide for IgH VJ Locus
gcctccctcgcgccatcaggacactctcactgtacctggcaagctgagtctccctaagtggactcagagagggggtggtgaggactcacctgaggagacggtgaccagggttccctggccccaggggtcgaaccagtcgacgacactctcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgacactctcactgtacctgagcgggctggcaaggc

SEQ ID NO: 2439 - DNA, 495 bp, Artificial Sequence
  Synthetic Template Oligonucleotide for IgH VJ Locus
gcctccctcgcgccatcaggacactctgatgatccctggcaagctgagtctccctaagtggactcagagagggggtggtgaggactcacctgaggagacggtgaccagggttccctggccccaggggtcgaaccagtcgacgacactctgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggacactctgatgatccctgagcgggctggcaaggc

SEQ ID NO: 2440 - DNA, 495 bp, Artificial Sequence
  Synthetic Template Oligonucleotide for IgH VJ Locus
gcctccctcgcgccatcaggacactctcgccaatactggcaagctgagtctccctaagtggactcagagagggggtggtgaggactcacctgaggagacggtgaccagggttccctggccccaggggtcgaaccagtcgacgacactctcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggacactctcgccaatactgagcgggctggcaaggc

SEQ ID NO: 2441 - DNA, 495 bp, Artificial Sequence
  Synthetic Template Oligonucleotide for IgH VJ Locus
gcctccctcgcgccatcaggacactcttcaagcctctggcaagctgagtctccctaagtggactcagagagggggtggtgaggactcacctgaggagacggtgaccagggttccctggccccaggggtcgaaccagtcgacgacactcttcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagacactcttcaagcctctgagcgggctggcaaggc

SEQ ID NO: 2442 - DNA, 495 bp, Artificial Sequence
  Synthetic Template Oligonucleotide for IgH VJ Locus
gcctccctcgcgccatcaggacactctacgtgtgtctggcaagctgagtctccctaagtggactcagagagggggtggtgaggactcacctgaggagacggtgaccagggttccctggccccaggggtcgaaccagtcgacgacactctacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggacactctacgtgtgtctgagcgggctggcaaggc

SEQ ID NO: 2443 - DNA, 495 bp, Artificial Sequence
  Synthetic Template Oligonucleotide for IgH VJ Locus
gcctccctcgcgccatcaggacactcttccgtctactggcaagctgagtctccctaagtggactcagagagggggtggtgaggactcacctgaggagacggtgaccagggttccctggccccaggggtcgaaccagtcgacgacactcttccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggacactcttccgtctactgagcgggctggcaaggc

SEQ ID NO: 2444 - DNA, 495 bp, Artificial Sequence
  Synthetic Template Oligonucleotide for IgH VJ Locus
gcctccctcgcgccatcaggacactctaagagctgctggcaagctgagtctccctaagtggactcagagagggggtggtgaggactcacctgaggagacggtgaccagggttccctggccccaggggtcgaaccagtcgacgacactctaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggacactctaagagctgctgagcgggctggcaaggc

SEQ ID NO: 2445 - DNA, 495 bp, Artificial Sequence
  Synthetic Template Oligonucleotide for IgH VJ Locus
gcctccctcgcgccatcaggacactcttatcgctcctggcaagctgagtctccctaagtggactcagagagggggtggtgaggactcacctgaggagacggtgaccagggttccctggccccaggggtcgaaccagtcgacgacactcttatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggacactcttatcgctcctgagcgggctggcaaggc

SEQ ID NO: 2446 - DNA, 495 bp, Artificial Sequence
  Synthetic Template Oligonucleotide for IgH VJ Locus
gcctccctcgcgccatcaggacactcttcagatgcctggcaagctgagtctccctaagtggactcagagagggggtggtgaggactcacctgaggagacggtgaccagggttccctggccccaggggtcgaaccagtcgacgacactcttcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgacactcttcagatgcctgagcgggctggcaaggc

SEQ ID NO: 2447 - DNA, 495 bp, Artificial Sequence
  Synthetic Template Oligonucleotide for IgH VJ Locus
gcctccctcgcgccatcaggacactctgtgtagcactggcaagctgagtctccctaagtggactcagagagggggtggtgaggactcacctgaggagacggtgaccagggttccctggccccaggggtcgaaccagtcgacgacactctgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggacactctgtgtagcactgagcgggctggcaaggc

SEQ ID NO: 2448 - DNA, 495 bp, Artificial Sequence
  Synthetic Template Oligonucleotide for IgH VJ Locus
gcctccctcgcgccatcaggacactcttggcagttctggcaagctgagtctccctaagtggactcagagagggggtggtgaggactcacctgaggagacggtgaccagggttccctggccccaggggtcgaaccagtcgacgacactcttggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggacactcttggcagttctgagcgggctggcaaggc

SEQ ID NO: 2449 - DNA, 495 bp, Artificial Sequence
  Synthetic Template Oligonucleotide for IgH VJ Locus
gcctccctcgcgccatcaggacactctcagtccaactggcaagctgagtctccctaagtggactcagagagggggtggtgaggactcacctgaggagacggtgaccagggttccctggccccaggggtcgaaccagtcgacgacactctcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgacactctcagtccaactgagcgggctggcaaggc

SEQ ID NO: 2450 - DNA, 495 bp, Artificial Sequence
  Synthetic Template Oligonucleotide for IgH VJ Locus
gcctccctcgcgccatcaggacactctgtgtctacctggcaagctgagtctccctaagtggactcagagagggggtggtgaggactcacctgaggagacggtgaccagggttccctggccccaggggtcgaaccagtcgacgacactctgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggacactctgtgtctacctgagcgggctggcaaggc

SEQ ID NO: 2451 - DNA, 495 bp, Artificial Sequence
  Synthetic Template Oligonucleotide for IgH VJ Locus
gcctccctcgcgccatcaggacactctgtacagtgctggcaagctgagtctccctaagtggactcagagagggggtggtgaggactcacctgaggagacggtgaccagggttccctggccccaggggtcgaaccagtcgacgacactctgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggacactctgtacagtgctgagcgggctggcaaggc

SEQ ID NO: 2452 - DNA, 495 bp, Artificial Sequence
  Synthetic Template Oligonucleotide for IgH VJ Locus
gcctccctcgcgccatcaggacactctggatcatcctggcaagctgagtctccctaagtggactcagagagggggtggtgaggactcacctgaggagacggtgaccagggttccctggccccaggggtcgaaccagtcgacgacactctggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggacactctggatcatcctgagcgggctggcaaggc

SEQ ID NO: 2453 - DNA, 495 bp, Artificial Sequence
  Synthetic Template Oligonucleotide for IgH VJ Locus
gcctccctcgcgccatcaggacactcttattggcgctggcaagctgagtctccctaagtggactcagagagggggtggtgaggactcacctgaggagacggtgaccagggttccctggccccaggggtcgaaccagtcgacgacactcttattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagacactcttattggcgctgagcgggctggcaaggc

SEQ ID NO: 2454 - DNA, 495 bp, Artificial Sequence
  Synthetic Template Oligonucleotide for IgH VJ Locus
gcctccctcgcgccatcaggacactctaggcttgactggcaagctgagtctccctaagtggactcagagagggggtggtgaggactcacctgaggagacggtgaccagggttccctggccccaggggtcgaaccagtcgacgacactctaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgacactctaggcttgactgagcgggctggcaaggc

SEQ ID NO: 2455 - DNA, 495 bp, Artificial Sequence
  Synthetic Template Oligonucleotide for IgH VJ Locus
gcctccctcgcgccatcaggacactctacacacgtctggcaagctgagtctccctaagtggactcagagagggggtggtgaggactcacctgaggagacggtgaccagggttccctggccccaggggtcgaaccagtcgacgacactctacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgacactctacacacgtctgagcgggctggcaaggc

SEQ ID NO: 2456 - DNA, 495 bp, Artificial Sequence
  Synthetic Template Oligonucleotide for IgH VJ Locus
gcctccctcgcgccatcaggacactcttagacggactggcaagctgagtctccctaagtggactcagagagggggtggtgaggactcacctgaggagacggtgaccagggttccctggccccaggggtcgaaccagtcgacgacactcttagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagacactcttagacggactgagcgggctggcaaggc

SEQ ID NO: 2457 - DNA, 495 bp, Artificial Sequence
  Synthetic Template Oligonucleotide for IgH VJ Locus
gcctccctcgcgccatcaggacactctgagcgatactggcaagctgagtctccctaagtggactcagagagggggtggtgaggactcacctgaggagacggtgaccagggttccctggccccaggggtcgaaccagtcgacgacactctgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgacactctgagcgatactgagcgggctggcaaggc

SEQ ID NO: 2458 - DNA, 495 bp, Artificial Sequence
  Synthetic Template Oligonucleotide for IgH VJ Locus
gcctccctcgcgccatcaggacactctgcatctgactggcaagctgagtctccctaagtggactcagagagggggtggtgaggactcacctgaggagacggtgaccagggttccctggccccaggggtcgaaccagtcgacgacactctgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagacactctgcatctgactgagcgggctggcaaggc

SEQ ID NO: 2459 - DNA, 495 bp, Artificial Sequence
  Synthetic Template Oligonucleotide for IgH VJ Locus
gcctccctcgcgccatcaggacactcttgctacacctggcaagctgagtctccctaagtggactcagagagggggtggtgaggactcacctgaggagacggtgaccagggttccctggccccaggggtcgaaccagtcgacgacactcttgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggacactcttgctacacctgagcgggctggcaaggc

SEQ ID NO: 2460 - DNA, 495 bp, Artificial Sequence
  Synthetic Template Oligonucleotide for IgH VJ Locus
gcctccctcgcgccatcaggacactctaactgccactggcaagctgagtctccctaagtggactcagagagggggtggtgaggactcacctgaggagacggtgaccagggttccctggccccaggggtcgaaccagtcgacgacactctaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgacactctaactgccactgagcgggctggcaaggc

SEQ ID NO: 2461 - DNA, 495 bp, Artificial Sequence
  Synthetic Template Oligonucleotide for IgH VJ Locus
gcctccctcgcgccatcaggacactctttggactgctggcaagctgagtctccctaagtggactcagagagggggtggtgaggactcacctgaggagacggtgaccagggttccctggccccaggggtcgaaccagtcgacgacactctttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggacactctttggactgctgagcgggctggcaaggc

SEQ ID NO: 2462 - DNA, 495 bp, Artificial Sequence
  Synthetic Template Oligonucleotide for IgH VJ Locus
gcctccctcgcgccatcaggacactcttcggtactctggcaagctgagtctccctaagtggactcagagagggggtggtgaggactcacctgaggagacggtgaccagggttccctggccccaggggtcgaaccagtcgacgacactcttcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggacactcttcggtactctgagcgggctggcaaggc

SEQ ID NO: 2463 - DNA, 495 bp, Artificial Sequence
  Synthetic Template Oligonucleotide for IgH VJ Locus
gcctccctcgcgccatcaggacactctccatggatctggcaagctgagtctccctaagtggactcagagagggggtggtgaggactcacctgaggagacggtgaccagggttccctggccccaggggtcgaaccagtcgacgacactctccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgacactctccatggatctgagcgggctggcaaggc

SEQ ID NO: 2464 - DNA, 495 bp, Artificial Sequence
  Synthetic Template Oligonucleotide for IgH VJ Locus
gcctccctcgcgccatcaggacactctacgaagatctggcaagctgagtctccctaagtggactcagagagggggtggtgaggactcacctgaggagacggtgaccagggttccctggccccaggggtcgaaccagtcgacgacactctacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagacactctacgaagatctgagcgggctggcaaggc

SEQ ID NO: 2465 - DNA, 495 bp, Artificial Sequence
  Synthetic Template Oligonucleotide for IgH VJ Locus
gcctccctcgcgccatcaggacactctactgtggactggcaagctgagtctccctaagtggactcagagagggggtggtgaggactcacctgaggagacggtgaccagggttccctggccccaggggtcgaaccagtcgacgacactctactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgacactctactgtggactgagcgggctggcaaggc

SEQ ID NO: 2466 - DNA, 495 bp, Artificial Sequence
  Synthetic Template Oligonucleotide for IgH VJ Locus
gcctccctcgcgccatcaggacactctggtgtcatctggcaagctgagtctccctaagtggactcagagagggggtggtgaggactcacctgaggagacggtgaccagggttccctggccccaggggtcgaaccagtcgacgacactctggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgacactctggtgtcatctgagcgggctggcaaggc

SEQ ID NO: 2467 - DNA, 495 bp, Artificial Sequence
  Synthetic Template Oligonucleotide for IgH VJ Locus
gcctccctcgcgccatcaggacactcttcgtgaagctggcaagctgagtctccctaagtggactcagagagggggtggtgaggactcacctgaggagacggtgaccagggttccctggccccaggggtcgaaccagtcgacgacactcttcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggacactcttcgtgaagctgagcgggctggcaaggc

SEQ ID NO: 2468 - DNA, 495 bp, Artificial Sequence
  Synthetic Template Oligonucleotide for IgH VJ Locus
gcctccctcgcgccatcaggacactctcactagctctggcaagctgagtctccctaagtggactcagagagggggtggtgaggactcacctgaggagacggtgaccagggttccctggccccaggggtcgaaccagtcgacgacactctcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagacactctcactagctctgagcgggctggcaaggc

SEQ ID NO: 2469 - DNA, 495 bp, Artificial Sequence
  Synthetic Template Oligonucleotide for IgH VJ Locus
gcctccctcgcgccatcaggacactctggtcaactctggcaagctgagtctccctaagtggactcagagagggggtggtgaggactcacctgaggagacggtgaccagggttccctggccccaggggtcgaaccagtcgacgacactctggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagacactctggtcaactctgagcgggctggcaaggc

SEQ ID NO: 2470 - DNA, 495 bp, Artificial Sequence
  Synthetic Template Oligonucleotide for IgH VJ Locus
gcctccctcgcgccatcaggacactcttacgtacgctggcaagctgagtctccctaagtggactcagagagggggtggtgaggactcacctgaggagacggtgaccagggttccctggccccaggggtcgaaccagtcgacgacactcttacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgacactcttacgtacgctgagcgggctggcaaggc

SEQ ID NO: 2471 - DNA, 495 bp, Artificial Sequence
  Synthetic Template Oligonucleotide for IgH VJ Locus
gcctccctcgcgccatcaggacactctatgacaccctggcaagctgagtctccctaagtggactcagagagggggtggtgaggactcacctgaggagacggtgaccagggttccctggccccaggggtcgaaccagtcgacgacactctatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggacactctatgacaccctgagcgggctggcaaggc

SEQ ID NO: 2472 - DNA, 495 bp, Artificial Sequence
  Synthetic Template Oligonucleotide for IgH VJ Locus
gcctccctcgcgccatcaggacactctcttcacgactggcaagctgagtctccctaagtggactcagagagggggtggtgaggactcacctgaggagacggtgaccagggttccctggccccaggggtcgaaccagtcgacgacactctcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgacactctcttcacgactgagcgggctggcaaggc

SEQ ID NO: 2473 - DNA, 495 bp, Artificial Sequence
  Synthetic Template Oligonucleotide for IgH VJ Locus
gcctccctcgcgccatcaggacactctagaatcagctggcaagctgagtctccctaagtggactcagagagggggtggtgaggactcacctgaggagacggtgaccagggttccctggccccaggggtcgaaccagtcgacgacactctagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgacactctagaatcagctgagcgggctggcaaggc

SEQ ID NO: 2474 - DNA, 495 bp, Artificial Sequence
  Synthetic Template Oligonucleotide for IgH VJ Locus
gcctccctcgcgccatcaggacactctagttatgcctggcaagctgagtctccctaagtggactcagagagggggtggtgaggactcacctgaggagacggtgaccagggttccctggccccaggggtcgaaccagtcgacgacactctagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagacactctagttatgcctgagcgggctggcaaggc

SEQ ID NO: 2475 - DNA, 495 bp, Artificial Sequence
  Synthetic Template Oligonucleotide for IgH VJ Locus
gcctccctcgcgccatcaggacactctaggtctcactggcaagctgagtctccctaagtggactcagagagggggtggtgaggactcacctgaggagacggtgaccagggttccctggccccaggggtcgaaccagtcgacgacactctaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgacactctaggtctcactgagcgggctggcaaggc

SEQ ID NO: 2476 - DNA, 495 bp, Artificial Sequence
  Synthetic Template Oligonucleotide for IgH VJ Locus
gcctccctcgcgccatcaggacactctgtcatagtctggcaagctgagtctccctaagtggactcagagagggggtggtgaggactcacctgaggagacggtgaccagggttccctggccccaggggtcgaaccagtcgacgacactctgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgacactctgtcatagtctgagcgggctggcaaggc

SEQ ID NO: 2477 - DNA, 495 bp, Artificial Sequence
  Synthetic Template Oligonucleotide for IgH VJ Locus
gcctccctcgcgccatcaggacactctgtgacttgctggcaagctgagtctccctaagtggactcagagagggggtggtgaggactcacctgaggagacggtgaccagggttccctggccccaggggtcgaaccagtcgacgacactctgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggacactctgtgacttgctgagcgggctggcaaggc

SEQ ID NO: 2478 - DNA, 495 bp, Artificial Sequence
  Synthetic Template Oligonucleotide for IgH VJ Locus
gcctccctcgcgccatcaggacactctgattgcagctggcaagctgagtctccctaagtggactcagagagggggtggtgaggactcacctgaggagacggtgaccagggttccctggccccaggggtcgaaccagtcgacgacactctgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgacactctgattgcagctgagcgggctggcaaggc

SEQ ID NO: 2479 - DNA, 495 bp, Artificial Sequence
  Synthetic Template Oligonucleotide for IgH VJ Locus
gcctccctcgcgccatcaggacactctactatgacctggcaagctgagtctccctaagtggactcagagagggggtggtgaggactcacctgaggagacggtgaccagggttccctggccccaggggtcgaaccagtcgacgacactctactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgacactctactatgacctgagcgggctggcaaggc

SEQ ID NO: 2480 - DNA, 495 bp, Artificial Sequence
  Synthetic Template Oligonucleotide for IgH VJ Locus
gcctccctcgcgccatcaggacactctatggtcaactggcaagctgagtctccctaagtggactcagagagggggtggtgaggactcacctgaggagacggtgaccagggttccctggccccaggggtcgaaccagtcgacgacactctatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgacactctatggtcaactgagcgggctggcaaggc

SEQ ID NO: 2481 - DNA, 495 bp, Artificial Sequence
  Synthetic Template Oligonucleotide for IgH VJ Locus
gcctccctcgcgccatcaggacactctgatggcttctggcaagctgagtctccctaagtggactcagagagggggtggtgaggactcacctgaggagacggtgaccagggttccctggccccaggggtcgaaccagtcgacgacactctgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgacactctgatggcttctgagcgggctggcaaggc

SEQ ID NO: 2482 - DNA, 495 bp, Artificial Sequence
  Synthetic Template Oligonucleotide for IgH VJ Locus
gcctccctcgcgccatcaggacactctagcatatgctggcaagctgagtctccctaagtggactcagagagggggtggtgaggactcacctgaggagacggtgaccagggttccctggccccaggggtcgaaccagtcgacgacactctagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgacactctagcatatgctgagcgggctggcaaggc

SEQ ID NO: 2483 - DNA, 495 bp, Artificial Sequence
  Synthetic Template Oligonucleotide for IgH VJ Locus
gcctccctcgcgccatcaggacactctcatatgctctggcaagctgagtctccctaagtggactcagagagggggtggtgaggactcacctgaggagacggtgaccagggttccctggccccaggggtcgaaccagtcgacgacactctcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggacactctcatatgctctgagcgggctggcaaggc

SEQ ID NO: 2484 - DNA, 495 bp, Artificial Sequence
  Synthetic Template Oligonucleotide for IgH VJ Locus
gcctccctcgcgccatcaggacactcttcgtcgatctggcaagctgagtctccctaagtggactcagagagggggtggtgaggactcacctgaggagacggtgaccagggttccctggccccaggggtcgaaccagtcgacgacactcttcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgacactcttcgtcgatctgagcgggctggcaaggc

SEQ ID NO: 2485 - DNA, 495 bp, Artificial Sequence
  Synthetic Template Oligonucleotide for IgH VJ Locus
gcctccctcgcgccatcaggacactctcagtctgtctggcaagctgagtctccctaagtggactcagagagggggtggtgaggactcacctgaggagacggtgaccagggttccctggccccaggggtcgaaccagtcgacgacactctcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgacactctcagtctgtctgagcgggctggcaaggc

SEQ ID NO: 2486 - DNA, 495 bp, Artificial Sequence
  Synthetic Template Oligonucleotide for IgH VJ Locus
gcctccctcgcgccatcaggacactctaacgcgtactggcaagctgagtctccctaagtggactcagagagggggtggtgaggactcacctgaggagacggtgaccagggttccctggccccaggggtcgaaccagtcgacgacactctaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggacactctaacgcgtactgagcgggctggcaaggc

SEQ ID NO: 2487 - DNA, 495 bp, Artificial Sequence
  Synthetic Template Oligonucleotide for IgH VJ Locus
gcctccctcgcgccatcaggacactctgtagttcgctggcaagctgagtctccctaagtggactcagagagggggtggtgaggactcacctgaggagacggtgaccagggttccctggccccaggggtcgaaccagtcgacgacactctgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgacactctgtagttcgctgagcgggctggcaaggc

SEQ ID NO: 2488 - DNA, 495 bp, Artificial Sequence
  Synthetic Template Oligonucleotide for IgH VJ Locus
gcctccctcgcgccatcaggacactctcgaactacctggcaagctgagtctccctaagtggactcagagagggggtggtgaggactcacctgaggagacggtgaccagggttccctggccccaggggtcgaaccagtcgacgacactctcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgacactctcgaactacctgagcgggctggcaaggc

SEQ ID NO: 2489 - DNA, 495 bp, Artificial Sequence
  Synthetic Template Oligonucleotide for IgH VJ Locus
gcctccctcgcgccatcaggacactctttaacgtcctggcaagctgagtctccctaagtggactcagagagggggtggtgaggactcacctgaggagacggtgaccagggttccctggccccaggggtcgaaccagtcgacgacactctttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgacactctttaacgtcctgagcgggctggcaaggc

SEQ ID NO: 2490 - DNA, 495 bp, Artificial Sequence
  Synthetic Template Oligonucleotide for IgH VJ Locus
gcctccctcgcgccatcaggacactctagcaacctctggcaagctgagtctccctaagtggactcagagagggggtggtgaggactcacctgaggagacggtgaccagggttccctggccccaggggtcgaaccagtcgacgacactctagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgacactctagcaacctctgagcgggctggcaaggc

SEQ ID NO: 2491 - DNA, 495 bp, Artificial Sequence
  Synthetic Template Oligonucleotide for IgH VJ Locus
gcctccctcgcgccatcaggacactctttctcgagctggcaagctgagtctccctaagtggactcagagagggggtggtgaggactcacctgaggagacggtgaccagggttccctggccccaggggtcgaaccagtcgacgacactctttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgacactctttctcgagctgagcgggctggcaaggc

SEQ ID NO: 2492 - DNA, 495 bp, Artificial Sequence
  Synthetic Template Oligonucleotide for IgH VJ Locus
gcctccctcgcgccatcaggacactctactctacgctggcaagctgagtctccctaagtggactcagagagggggtggtgaggactcacctgaggagacggtgaccagggttccctggccccaggggtcgaaccagtcgacgacactctactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgacactctactctacgctgagcgggctggcaaggc

SEQ ID NO: 2493 - DNA, 495 bp, Artificial Sequence
  Synthetic Template Oligonucleotide for IgH VJ Locus
gcctccctcgcgccatcaggacactcttaccggaactggcaagctgagtctccctaagtggactcagagagggggtggtgaggactcacctgaggagacggtgaccagggttccctggccccaggggtcgaaccagtcgacgacactcttaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgacactcttaccggaactgagcgggctggcaaggc

SEQ ID NO: 2494 - DNA, 495 bp, Artificial Sequence
  Synthetic Template Oligonucleotide for IgH VJ Locus
gcctccctcgcgccatcaggacactctcgaattgcctggcaagctgagtctccctaagtggactcagagagggggtggtgaggactcacctgaggagacggtgaccagggttccctggccccaggggtcgaaccagtcgacgacactctcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgacactctcgaattgcctgagcgggctggcaaggc

SEQ ID NO: 2495 - DNA, 495 bp, Artificial Sequence
  Synthetic Template Oligonucleotide for IgH VJ Locus
gcctccctcgcgccatcaggacactctttcgctcactggcaagctgagtctccctaagtggactcagagagggggtggtgaggactcacctgaggagacggtgaccagggttccctggccccaggggtcgaaccagtcgacgacactctttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagacactctttcgctcactgagcgggctggcaaggc

SEQ ID NO: 2496 - DNA, 495 bp, Artificial Sequence
  Synthetic Template Oligonucleotide for IgH VJ Locus
gcctccctcgcgccatcaggacactctgacgttaactggcaagctgagtctccctaagtggactcagagagggggtggtgaggactcacctgaggagacggtgaccagggttccctggccccaggggtcgaaccagtcgacgacactctgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggacactctgacgttaactgagcgggctggcaaggc

SEQ ID NO: 2497 - DNA, 495 bp, Artificial Sequence
  Synthetic Template Oligonucleotide for IgH VJ Locus
gcctccctcgcgccatcaggacactctcgtagagtctggcaagctgagtctccctaagtggactcagagagggggtggtgaggactcacctgaggagacggtgaccagggttccctggccccaggggtcgaaccagtcgacgacactctcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgacactctcgtagagtctgagcgggctggcaaggc

SEQ ID NO: 2498 - DNA, 495 bp, Artificial Sequence
  Synthetic Template Oligonucleotide for IgH VJ Locus
gcctccctcgcgccatcaggacactctttccggtactggcaagctgagtctccctaagtggactcagagagggggtggtgaggactcacctgaggagacggtgaccagggttccctggccccaggggtcgaaccagtcgacgacactctttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgacactctttccggtactgagcgggctggcaaggc

SEQ ID NO: 2499 - DNA, 495 bp, Artificial Sequence
  Synthetic Template Oligonucleotide for IgH VJ Locus
gcctccctcgcgccatcaggacactctgcaattcgctggcaagctgagtctccctaagtggactcagagagggggtggtgaggactcacctgaggagacggtgaccagggttccctggccccaggggtcgaaccagtcgacgacactctgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgacactctgcaattcgctgagcgggctggcaaggc

SEQ ID NO: 2500 - DNA, 495 bp, Artificial Sequence
  Synthetic Template Oligonucleotide for IgH VJ Locus
gcctccctcgcgccatcaggacactcttgagcgaactggcaagctgagtctccctaagtggactcagagagggggtggtgaggactcacctgaggagacggtgaccagggttccctggccccaggggtcgaaccagtcgacgacactcttgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgacactcttgagcgaactgagcgggctggcaaggc

SEQ ID NO: 2501 - DNA, 495 bp, Artificial Sequence
  Synthetic Template Oligonucleotide for IgH VJ Locus
gcctccctcgcgccatcaggacactcttactaagcctggcaagctgagtctccctaagtggactcagagagggggtggtgaggactcacctgaggagacggtgaccagggttccctggccccaggggtcgaaccagtcgacgacactcttactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgacactcttactaagcctgagcgggctggcaaggc

SEQ ID NO: 2502 - DNA, 495 bp, Artificial Sequence
  Synthetic Template Oligonucleotide for IgH VJ Locus
gcctccctcgcgccatcaggacactcttggcgtatctggcaagctgagtctccctaagtggactcagagagggggtggtgaggactcacctgaggagacggtgaccagggttccctggccccaggggtcgaaccagtcgacgacactcttggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgacactcttggcgtatctgagcgggctggcaaggc

SEQ ID NO: 2503 - DNA, 495 bp, Artificial Sequence
  Synthetic Template Oligonucleotide for IgH VJ Locus
gcctccctcgcgccatcaggacactctgataaccactggcaagctgagtctccctaagtggactcagagagggggtggtgaggactcacctgaggagacggtgaccagggttccctggccccaggggtcgaaccagtcgacgacactctgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggacactctgataaccactgagcgggctggcaaggc

SEQ ID NO: 2504 - DNA, 495 bp, Artificial Sequence
  Synthetic Template Oligonucleotide for IgH VJ Locus
gcctccctcgcgccatcaggacactctctagtgaactggcaagctgagtctccctaagtggactcagagagggggtggtgaggactcacctgaggagacggtgaccagggttccctggccccaggggtcgaaccagtcgacgacactctctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggacactctctagtgaactgagcgggctggcaaggc

SEQ ID NO: 2505 - DNA, 495 bp, Artificial Sequence
  Synthetic Template Oligonucleotide for IgH VJ Locus
gcctccctcgcgccatcaggacactctacgttcacctggcaagctgagtctccctaagtggactcagagagggggtggtgaggactcacctgaggagacggtgaccagggttccctggccccaggggtcgaaccagtcgacgacactctacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgacactctacgttcacctgagcgggctggcaaggc

SEQ ID NO: 2506 - DNA, 448 bp, Artificial Sequence
  Synthetic Template Oligonucleotide for IgH VJ Locus
gcctccctcgcgccatcaggacactctattacgctctggcaagctgagtctccctaagtggactcagagagggggtggtgaggactcacctgaggagacggtgaccagggttccctggccccaggggtcgaaccagtcgacgacactctattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagacactctattacgctctgagcgggctggcaaggc

SEQ ID NO: 2507 - DNA, 495 bp, Artificial Sequence
  Synthetic Template Oligonucleotide for IgH VJ Locus
gcctccctcgcgccatcaggacactctcattgagtctggcaagctgagtctccctaagtggactcagagagggggtggtgaggactcacctgaggagacggtgaccagggttccctggccccaggggtcgaaccagtcgacgacactctcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgacactctcattgagtctgagcgggctggcaaggc

SEQ ID NO: 2508 - DNA, 495 bp, Artificial Sequence
  Synthetic Template Oligonucleotide for IgH VJ Locus
gcctccctcgcgccatcagttcggaaccttggttaggcagtagcagaaaacaaaggccctagagtggccattcttacctgaggagacggtgaccgtggtccctttgccccagacgtccatgtagtagtagtagtagtcgacttcggaaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccttcggaaccttggttactgagcgggctggcaaggc

SEQ ID NO: 2509 - DNA, 495 bp, Artificial Sequence
  Synthetic Template Oligonucleotide for IgH VJ Locus
gcctccctcgcgccatcagttcggaacacctcttgggcagtagcagaaaacaaaggccctagagtggccattcttacctgaggagacggtgaccgtggtccctttgccccagacgtccatgtagtagtagtagtagtcgacttcggaacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccttcggaacacctcttgctgagcgggctggcaaggc

SEQ ID NO: 2510 - DNA, 495 bp, Artificial Sequence
  Synthetic Template Oligonucleotide for IgH VJ Locus
gcctccctcgcgccatcagttcggaacctgattctggcagtagcagaaaacaaaggccctagagtggccattcttacctgaggagacggtgaccgtggtccctttgccccagacgtccatgtagtagtagtagtagtcgacttcggaacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccttcggaacctgattctctgagcgggctggcaaggc

SEQ ID NO: 2511 - DNA, 495 bp, Artificial Sequence
  Synthetic Template Oligonucleotide for IgH VJ Locus
gcctccctcgcgccatcagttcggaacagtaccgaggcagtagcagaaaacaaaggccctagagtggccattcttacctgaggagacggtgaccgtggtccctttgccccagacgtccatgtagtagtagtagtagtcgacttcggaacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccttcggaacagtaccgactgagcgggctggcaaggc

SEQ ID NO: 2512 - DNA, 495 bp, Artificial Sequence
  Synthetic Template Oligonucleotide for IgH VJ Locus
gcctccctcgcgccatcagttcggaacatccatggggcagtagcagaaaacaaaggccctagagtggccattcttacctgaggagacggtgaccgtggtccctttgccccagacgtccatgtagtagtagtagtagtcgacttcggaacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccttcggaacatccatggctgagcgggctggcaaggc

SEQ ID NO: 2513 - DNA, 495 bp, Artificial Sequence
  Synthetic Template Oligonucleotide for IgH VJ Locus
gcctccctcgcgccatcagttcggaacgtagcagtggcagtagcagaaaacaaaggccctagagtggccattcttacctgaggagacggtgaccgtggtccctttgccccagacgtccatgtagtagtagtagtagtcgacttcggaacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcttcggaacgtagcagtctgagcgggctggcaaggc

SEQ ID NO: 2514 - DNA, 495 bp, Artificial Sequence
  Synthetic Template Oligonucleotide for IgH VJ Locus
gcctccctcgcgccatcagttcggaacatcttcgtggcagtagcagaaaacaaaggccctagagtggccattcttacctgaggagacggtgaccgtggtccctttgccccagacgtccatgtagtagtagtagtagtcgacttcggaacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccttcggaacatcttcgtctgagcgggctggcaaggc

SEQ ID NO: 2515 - DNA, 495 bp, Artificial Sequence
  Synthetic Template Oligonucleotide for IgH VJ Locus
gcctccctcgcgccatcagttcggaactccacagtggcagtagcagaaaacaaaggccctagagtggccattcttacctgaggagacggtgaccgtggtccctttgccccagacgtccatgtagtagtagtagtagtcgacttcggaactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccttcggaactccacagtctgagcgggctggcaaggc

SEQ ID NO: 2516 - DNA, 495 bp, Artificial Sequence
  Synthetic Template Oligonucleotide for IgH VJ Locus
gcctccctcgcgccatcagttcggaacagctagtgggcagtagcagaaaacaaaggccctagagtggccattcttacctgaggagacggtgaccgtggtccctttgccccagacgtccatgtagtagtagtagtagtcgacttcggaacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccttcggaacagctagtgctgagcgggctggcaaggc

SEQ ID NO: 2517 - DNA, 495 bp, Artificial Sequence
  Synthetic Template Oligonucleotide for IgH VJ Locus
gcctccctcgcgccatcagttcggaactaaccaagggcagtagcagaaaacaaaggccctagagtggccattcttacctgaggagacggtgaccgtggtccctttgccccagacgtccatgtagtagtagtagtagtcgacttcggaactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccttcggaactaaccaagctgagcgggctggcaaggc

SEQ ID NO: 2518 - DNA, 495 bp, Artificial Sequence
  Synthetic Template Oligonucleotide for IgH VJ Locus
gcctccctcgcgccatcagttcggaaccaagaggtggcagtagcagaaaacaaaggccctagagtggccattcttacctgaggagacggtgaccgtggtccctttgccccagacgtccatgtagtagtagtagtagtcgacttcggaaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccttcggaaccaagaggtctgagcgggctggcaaggc

SEQ ID NO: 2519 - DNA, 495 bp, Artificial Sequence
  Synthetic Template Oligonucleotide for IgH VJ Locus
gcctccctcgcgccatcagttcggaacagttgaccggcagtagcagaaaacaaaggccctagagtggccattcttacctgaggagacggtgaccgtggtccctttgccccagacgtccatgtagtagtagtagtagtcgacttcggaacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaattcggaacagttgaccctgagcgggctggcaaggc

SEQ ID NO: 2520 - DNA, 495 bp, Artificial Sequence
  Synthetic Template Oligonucleotide for IgH VJ Locus
gcctccctcgcgccatcagttcggaaccagcatatggcagtagcagaaaacaaaggccctagagtggccattcttacctgaggagacggtgaccgtggtccctttgccccagacgtccatgtagtagtagtagtagtcgacttcggaaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaattcggaaccagcatatctgagcgggctggcaaggc

SEQ ID NO: 2521 - DNA, 495 bp, Artificial Sequence
  Synthetic Template Oligonucleotide for IgH VJ Locus
gcctccctcgcgccatcagttcggaacgcaggattggcagtagcagaaaacaaaggccctagagtggccattcttacctgaggagacggtgaccgtggtccctttgccccagacgtccatgtagtagtagtagtagtcgacttcggaacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataattcggaacgcaggattctgagcgggctggcaaggc

SEQ ID NO: 2522 - DNA, 495 bp, Artificial Sequence
  Synthetic Template Oligonucleotide for IgH VJ Locus
gcctccctcgcgccatcagttcggaacgtccattcggcagtagcagaaaacaaaggccctagagtggccattcttacctgaggagacggtgaccgtggtccctttgccccagacgtccatgtagtagtagtagtagtcgacttcggaacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccttcggaacgtccattcctgagcgggctggcaaggc

SEQ ID NO: 2523 - DNA, 495 bp, Artificial Sequence
  Synthetic Template Oligonucleotide for IgH VJ Locus
gcctccctcgcgccatcagttcggaacgcataactggcagtagcagaaaacaaaggccctagagtggccattcttacctgaggagacggtgaccgtggtccctttgccccagacgtccatgtagtagtagtagtagtcgacttcggaacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacttcggaacgcataactctgagcgggctggcaaggc

SEQ ID NO: 2524 - DNA, 495 bp, Artificial Sequence
  Synthetic Template Oligonucleotide for IgH VJ Locus
gcctccctcgcgccatcagttcggaacatatgctgggcagtagcagaaaacaaaggccctagagtggccattcttacctgaggagacggtgaccgtggtccctttgccccagacgtccatgtagtagtagtagtagtcgacttcggaacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccttcggaacatatgctgctgagcgggctggcaaggc

SEQ ID NO: 2525 - DNA, 495 bp, Artificial Sequence
  Synthetic Template Oligonucleotide for IgH VJ Locus
gcctccctcgcgccatcagttcggaacaatcctgcggcagtagcagaaaacaaaggccctagagtggccattcttacctgaggagacggtgaccgtggtccctttgccccagacgtccatgtagtagtagtagtagtcgacttcggaacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcttcggaacaatcctgcctgagcgggctggcaaggc

SEQ ID NO: 2526 - DNA, 495 bp, Artificial Sequence
  Synthetic Template Oligonucleotide for IgH VJ Locus
gcctccctcgcgccatcagttcggaactgagacctggcagtagcagaaaacaaaggccctagagtggccattcttacctgaggagacggtgaccgtggtccctttgccccagacgtccatgtagtagtagtagtagtcgacttcggaactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgttcggaactgagacctctgagcgggctggcaaggc

SEQ ID NO: 2527 - DNA, 495 bp, Artificial Sequence
  Synthetic Template Oligonucleotide for IgH VJ Locus
gcctccctcgcgccatcagttcggaacgaatggacggcagtagcagaaaacaaaggccctagagtggccattcttacctgaggagacggtgaccgtggtccctttgccccagacgtccatgtagtagtagtagtagtcgacttcggaacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccttcggaacgaatggacctgagcgggctggcaaggc

SEQ ID NO: 2528 - DNA, 495 bp, Artificial Sequence
  Synthetic Template Oligonucleotide for IgH VJ Locus
gcctccctcgcgccatcagttcggaaccacatggaggcagtagcagaaaacaaaggccctagagtggccattcttacctgaggagacggtgaccgtggtccctttgccccagacgtccatgtagtagtagtagtagtcgacttcggaaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccttcggaaccacatggactgagcgggctggcaaggc

SEQ ID NO: 2529 - DNA, 495 bp, Artificial Sequence
  Synthetic Template Oligonucleotide for IgH VJ Locus
gcctccctcgcgccatcagttcggaacttgaccatggcagtagcagaaaacaaaggccctagagtggccattcttacctgaggagacggtgaccgtggtccctttgccccagacgtccatgtagtagtagtagtagtcgacttcggaacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccttcggaacttgaccatctgagcgggctggcaaggc

SEQ ID NO: 2530 - DNA, 495 bp, Artificial Sequence
  Synthetic Template Oligonucleotide for IgH VJ Locus
gcctccctcgcgccatcagttcggaacaagccatcggcagtagcagaaaacaaaggccctagagtggccattcttacctgaggagacggtgaccgtggtccctttgccccagacgtccatgtagtagtagtagtagtcgacttcggaacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccttcggaacaagccatcctgagcgggctggcaaggc

SEQ ID NO: 2531 - DNA, 495 bp, Artificial Sequence
  Synthetic Template Oligonucleotide for IgH VJ Locus
gcctccctcgcgccatcagttcggaactccatgtgggcagtagcagaaaacaaaggccctagagtggccattcttacctgaggagacggtgaccgtggtccctttgccccagacgtccatgtagtagtagtagtagtcgacttcggaactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccttcggaactccatgtgctgagcgggctggcaaggc

SEQ ID NO: 2532 - DNA, 495 bp, Artificial Sequence
  Synthetic Template Oligonucleotide for IgH VJ Locus
gcctccctcgcgccatcagttcggaaccaagtcacggcagtagcagaaaacaaaggccctagagtggccattcttacctgaggagacggtgaccgtggtccctttgccccagacgtccatgtagtagtagtagtagtcgacttcggaaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccttcggaaccaagtcacctgagcgggctggcaaggc

SEQ ID NO: 2533 - DNA, 495 bp, Artificial Sequence
  Synthetic Template Oligonucleotide for IgH VJ Locus
gcctccctcgcgccatcagttcggaacctgcaatcggcagtagcagaaaacaaaggccctagagtggccattcttacctgaggagacggtgaccgtggtccctttgccccagacgtccatgtagtagtagtagtagtcgacttcggaacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccttcggaacctgcaatcctgagcgggctggcaaggc

SEQ ID NO: 2534 - DNA, 495 bp, Artificial Sequence
  Synthetic Template Oligonucleotide for IgH VJ Locus
gcctccctcgcgccatcagttcggaacatcgacgaggcagtagcagaaaacaaaggccctagagtggccattcttacctgaggagacggtgaccgtggtccctttgccccagacgtccatgtagtagtagtagtagtcgacttcggaacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccttcggaacatcgacgactgagcgggctggcaaggc

SEQ ID NO: 2535 - DNA, 495 bp, Artificial Sequence
  Synthetic Template Oligonucleotide for IgH VJ Locus
gcctccctcgcgccatcagttcggaacacagactgggcagtagcagaaaacaaaggccctagagtggccattcttacctgaggagacggtgaccgtggtccctttgccccagacgtccatgtagtagtagtagtagtcgacttcggaacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaattcggaacacagactgctgagcgggctggcaaggc

SEQ ID NO: 2536 - DNA, 495 bp, Artificial Sequence
  Synthetic Template Oligonucleotide for IgH VJ Locus
gcctccctcgcgccatcagttcggaacccttatagggcagtagcagaaaacaaaggccctagagtggccattcttacctgaggagacggtgaccgtggtccctttgccccagacgtccatgtagtagtagtagtagtcgacttcggaacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacttcggaacccttatagctgagcgggctggcaaggc

SEQ ID NO: 2537 - DNA, 495 bp, Artificial Sequence
  Synthetic Template Oligonucleotide for IgH VJ Locus
gcctccctcgcgccatcagttcggaactacgcgttggcagtagcagaaaacaaaggccctagagtggccattcttacctgaggagacggtgaccgtggtccctttgccccagacgtccatgtagtagtagtagtagtcgacttcggaactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccttcggaactacgcgttctgagcgggctggcaaggc

SEQ ID NO: 2538 - DNA, 495 bp, Artificial Sequence
  Synthetic Template Oligonucleotide for IgH VJ Locus
gcctccctcgcgccatcagttcggaacctataaggggcagtagcagaaaacaaaggccctagagtggccattcttacctgaggagacggtgaccgtggtccctttgccccagacgtccatgtagtagtagtagtagtcgacttcggaacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgttcggaacctataaggctgagcgggctggcaaggc

SEQ ID NO: 2539 - DNA, 495 bp, Artificial Sequence
  Synthetic Template Oligonucleotide for IgH VJ Locus
gcctccctcgcgccatcagttcggaactcttagtcggcagtagcagaaaacaaaggccctagagtggccattcttacctgaggagacggtgaccgtggtccctttgccccagacgtccatgtagtagtagtagtagtcgacttcggaactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcttcggaactcttagtcctgagcgggctggcaaggc

SEQ ID NO: 2540 - DNA, 495 bp, Artificial Sequence
  Synthetic Template Oligonucleotide for IgH VJ Locus
gcctccctcgcgccatcagttcggaactgtctgcaggcagtagcagaaaacaaaggccctagagtggccattcttacctgaggagacggtgaccgtggtccctttgccccagacgtccatgtagtagtagtagtagtcgacttcggaactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccttcggaactgtctgcactgagcgggctggcaaggc

SEQ ID NO: 2541 - DNA, 495 bp, Artificial Sequence
  Synthetic Template Oligonucleotide for IgH VJ Locus
gcctccctcgcgccatcagttcggaacgccattaaggcagtagcagaaaacaaaggccctagagtggccattcttacctgaggagacggtgaccgtggtccctttgccccagacgtccatgtagtagtagtagtagtcgacttcggaacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcttcggaacgccattaactgagcgggctggcaaggc

SEQ ID NO: 2542 - DNA, 495 bp, Artificial Sequence
  Synthetic Template Oligonucleotide for IgH VJ Locus
gcctccctcgcgccatcagttcggaacgactaagaggcagtagcagaaaacaaaggccctagagtggccattcttacctgaggagacggtgaccgtggtccctttgccccagacgtccatgtagtagtagtagtagtcgacttcggaacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgttcggaacgactaagactgagcgggctggcaaggc

SEQ ID NO: 2543 - DNA, 495 bp, Artificial Sequence
  Synthetic Template Oligonucleotide for IgH VJ Locus
gcctccctcgcgccatcagttcggaacaggttgctggcagtagcagaaaacaaaggccctagagtggccattcttacctgaggagacggtgaccgtggtccctttgccccagacgtccatgtagtagtagtagtagtcgacttcggaacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgttcggaacaggttgctctgagcgggctggcaaggc

SEQ ID NO: 2544 - DNA, 495 bp, Artificial Sequence
  Synthetic Template Oligonucleotide for IgH VJ Locus
gcctccctcgcgccatcagttcggaacctcgagaaggcagtagcagaaaacaaaggccctagagtggccattcttacctgaggagacggtgaccgtggtccctttgccccagacgtccatgtagtagtagtagtagtcgacttcggaacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccttcggaacctcgagaactgagcgggctggcaaggc

SEQ ID NO: 2545 - DNA, 495 bp, Artificial Sequence
  Synthetic Template Oligonucleotide for IgH VJ Locus
gcctccctcgcgccatcagttcggaacttaatggcggcagtagcagaaaacaaaggccctagagtggccattcttacctgaggagacggtgaccgtggtccctttgccccagacgtccatgtagtagtagtagtagtcgacttcggaacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccttcggaacttaatggcctgagcgggctggcaaggc

SEQ ID NO: 2546 - DNA, 495 bp, Artificial Sequence
  Synthetic Template Oligonucleotide for IgH VJ Locus
gcctccctcgcgccatcagttcggaactgcagacaggcagtagcagaaaacaaaggccctagagtggccattcttacctgaggagacggtgaccgtggtccctttgccccagacgtccatgtagtagtagtagtagtcgacttcggaactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaattcggaactgcagacactgagcgggctggcaaggc

SEQ ID NO: 2547 - DNA, 495 bp, Artificial Sequence
  Synthetic Template Oligonucleotide for IgH VJ Locus
gcctccctcgcgccatcagttcggaactcactgagggcagtagcagaaaacaaaggccctagagtggccattcttacctgaggagacggtgaccgtggtccctttgccccagacgtccatgtagtagtagtagtagtcgacttcggaactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtttcggaactcactgagctgagcgggctggcaaggc

SEQ ID NO: 2548 - DNA, 495 bp, Artificial Sequence
  Synthetic Template Oligonucleotide for IgH VJ Locus
gcctccctcgcgccatcagttcggaacgagtacgtggcagtagcagaaaacaaaggccctagagtggccattcttacctgaggagacggtgaccgtggtccctttgccccagacgtccatgtagtagtagtagtagtcgacttcggaacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacttcggaacgagtacgtctgagcgggctggcaaggc

SEQ ID NO: 2549 - DNA, 495 bp, Artificial Sequence
  Synthetic Template Oligonucleotide for IgH VJ Locus
gcctccctcgcgccatcagttcggaacatacgccaggcagtagcagaaaacaaaggccctagagtggccattcttacctgaggagacggtgaccgtggtccctttgccccagacgtccatgtagtagtagtagtagtcgacttcggaacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacttcggaacatacgccactgagcgggctggcaaggc

SEQ ID NO: 2550 - DNA, 495 bp, Artificial Sequence
  Synthetic Template Oligonucleotide for IgH VJ Locus
gcctccctcgcgccatcagttcggaactcgcatcaggcagtagcagaaaacaaaggccctagagtggccattcttacctgaggagacggtgaccgtggtccctttgccccagacgtccatgtagtagtagtagtagtcgacttcggaactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacttcggaactcgcatcactgagcgggctggcaaggc

SEQ ID NO: 2551 - DNA, 495 bp, Artificial Sequence
  Synthetic Template Oligonucleotide for IgH VJ Locus
gcctccctcgcgccatcagttcggaaccgcttaatggcagtagcagaaaacaaaggccctagagtggccattcttacctgaggagacggtgaccgtggtccctttgccccagacgtccatgtagtagtagtagtagtcgacttcggaaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacttcggaaccgcttaatctgagcgggctggcaaggc

SEQ ID NO: 2552 - DNA, 495 bp, Artificial Sequence
  Synthetic Template Oligonucleotide for IgH VJ Locus
gcctccctcgcgccatcagttcggaactggttatcggcagtagcagaaaacaaaggccctagagtggccattcttacctgaggagacggtgaccgtggtccctttgccccagacgtccatgtagtagtagtagtagtcgacttcggaactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtttcggaactggttatcctgagcgggctggcaaggc

SEQ ID NO: 2553 - DNA, 495 bp, Artificial Sequence
  Synthetic Template Oligonucleotide for IgH VJ Locus
gcctccctcgcgccatcagttcggaacggattgctggcagtagcagaaaacaaaggccctagagtggccattcttacctgaggagacggtgaccgtggtccctttgccccagacgtccatgtagtagtagtagtagtcgacttcggaacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacttcggaacggattgctctgagcgggctggcaaggc

SEQ ID NO: 2554 - DNA, 495 bp, Artificial Sequence
  Synthetic Template Oligonucleotide for IgH VJ Locus
gcctccctcgcgccatcagttcggaacctcagtgaggcagtagcagaaaacaaaggccctagagtggccattcttacctgaggagacggtgaccgtggtccctttgccccagacgtccatgtagtagtagtagtagtcgacttcggaacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtttcggaacctcagtgactgagcgggctggcaaggc

SEQ ID NO: 2555 - DNA, 495 bp, Artificial Sequence
  Synthetic Template Oligonucleotide for IgH VJ Locus
gcctccctcgcgccatcagttcggaacacgtactcggcagtagcagaaaacaaaggccctagagtggccattcttacctgaggagacggtgaccgtggtccctttgccccagacgtccatgtagtagtagtagtagtcgacttcggaacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacttcggaacacgtactcctgagcgggctggcaaggc

SEQ ID NO: 2556 - DNA, 495 bp, Artificial Sequence
  Synthetic Template Oligonucleotide for IgH VJ Locus
gcctccctcgcgccatcagttcggaactgatgcgaggcagtagcagaaaacaaaggccctagagtggccattcttacctgaggagacggtgaccgtggtccctttgccccagacgtccatgtagtagtagtagtagtcgacttcggaactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccttcggaactgatgcgactgagcgggctggcaaggc

SEQ ID NO: 2557 - DNA, 495 bp, Artificial Sequence
  Synthetic Template Oligonucleotide for IgH VJ Locus
gcctccctcgcgccatcagttcggaacattaagcgggcagtagcagaaaacaaaggccctagagtggccattcttacctgaggagacggtgaccgtggtccctttgccccagacgtccatgtagtagtagtagtagtcgacttcggaacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccttcggaacattaagcgctgagcgggctggcaaggc

SEQ ID NO: 2558 - DNA, 495 bp, Artificial Sequence
  Synthetic Template Oligonucleotide for IgH VJ Locus
gcctccctcgcgccatcagttcggaacagcaatccggcagtagcagaaaacaaaggccctagagtggccattcttacctgaggagacggtgaccgtggtccctttgccccagacgtccatgtagtagtagtagtagtcgacttcggaacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccttcggaacagcaatccctgagcgggctggcaaggc

SEQ ID NO: 2559 - DNA, 495 bp, Artificial Sequence
  Synthetic Template Oligonucleotide for IgH VJ Locus
gcctccctcgcgccatcagttcggaacgcttagtaggcagtagcagaaaacaaaggccctagagtggccattcttacctgaggagacggtgaccgtggtccctttgccccagacgtccatgtagtagtagtagtagtcgacttcggaacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgattcggaacgcttagtactgagcgggctggcaaggc

SEQ ID NO: 2560 - DNA, 495 bp, Artificial Sequence
  Synthetic Template Oligonucleotide for IgH VJ Locus
gcctccctcgcgccatcagttcggaactgaccttgggcagtagcagaaaacaaaggccctagagtggccattcttacctgaggagacggtgaccgtggtccctttgccccagacgtccatgtagtagtagtagtagtcgacttcggaactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccttcggaactgaccttgctgagcgggctggcaaggc

SEQ ID NO: 2561 - DNA, 495 bp, Artificial Sequence
  Synthetic Template Oligonucleotide for IgH VJ Locus
gcctccctcgcgccatcagttcggaaccaaggtcaggcagtagcagaaaacaaaggccctagagtggccattcttacctgaggagacggtgaccgtggtccctttgccccagacgtccatgtagtagtagtagtagtcgacttcggaaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccttcggaaccaaggtcactgagcgggctggcaaggc

SEQ ID NO: 2562 - DNA, 495 bp, Artificial Sequence
  Synthetic Template Oligonucleotide for IgH VJ Locus
gcctccctcgcgccatcagttcggaaccactgtacggcagtagcagaaaacaaaggccctagagtggccattcttacctgaggagacggtgaccgtggtccctttgccccagacgtccatgtagtagtagtagtagtcgacttcggaaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcttcggaaccactgtacctgagcgggctggcaaggc

SEQ ID NO: 2563 - DNA, 495 bp, Artificial Sequence
  Synthetic Template Oligonucleotide for IgH VJ Locus
gcctccctcgcgccatcagttcggaacgatgatccggcagtagcagaaaacaaaggccctagagtggccattcttacctgaggagacggtgaccgtggtccctttgccccagacgtccatgtagtagtagtagtagtcgacttcggaacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggttcggaacgatgatccctgagcgggctggcaaggc

SEQ ID NO: 2564 - DNA, 495 bp, Artificial Sequence
  Synthetic Template Oligonucleotide for IgH VJ Locus
gcctccctcgcgccatcagttcggaaccgccaataggcagtagcagaaaacaaaggccctagagtggccattcttacctgaggagacggtgaccgtggtccctttgccccagacgtccatgtagtagtagtagtagtcgacttcggaaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggttcggaaccgccaatactgagcgggctggcaaggc

SEQ ID NO: 2565 - DNA, 495 bp, Artificial Sequence
  Synthetic Template Oligonucleotide for IgH VJ Locus
gcctccctcgcgccatcagttcggaactcaagcctggcagtagcagaaaacaaaggccctagagtggccattcttacctgaggagacggtgaccgtggtccctttgccccagacgtccatgtagtagtagtagtagtcgacttcggaactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacattcggaactcaagcctctgagcgggctggcaaggc

SEQ ID NO: 2566 - DNA, 495 bp, Artificial Sequence
  Synthetic Template Oligonucleotide for IgH VJ Locus
gcctccctcgcgccatcagttcggaacacgtgtgtggcagtagcagaaaacaaaggccctagagtggccattcttacctgaggagacggtgaccgtggtccctttgccccagacgtccatgtagtagtagtagtagtcgacttcggaacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagttcggaacacgtgtgtctgagcgggctggcaaggc

SEQ ID NO: 2567 - DNA, 495 bp, Artificial Sequence
  Synthetic Template Oligonucleotide for IgH VJ Locus
gcctccctcgcgccatcagttcggaactccgtctaggcagtagcagaaaacaaaggccctagagtggccattcttacctgaggagacggtgaccgtggtccctttgccccagacgtccatgtagtagtagtagtagtcgacttcggaactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagttcggaactccgtctactgagcgggctggcaaggc

SEQ ID NO: 2568 - DNA, 495 bp, Artificial Sequence
  Synthetic Template Oligonucleotide for IgH VJ Locus
gcctccctcgcgccatcagttcggaacaagagctgggcagtagcagaaaacaaaggccctagagtggccattcttacctgaggagacggtgaccgtggtccctttgccccagacgtccatgtagtagtagtagtagtcgacttcggaacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgttcggaacaagagctgctgagcgggctggcaaggc

SEQ ID NO: 2569 - DNA, 495 bp, Artificial Sequence
  Synthetic Template Oligonucleotide for IgH VJ Locus
gcctccctcgcgccatcagttcggaactatcgctcggcagtagcagaaaacaaaggccctagagtggccattcttacctgaggagacggtgaccgtggtccctttgccccagacgtccatgtagtagtagtagtagtcgacttcggaactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagttcggaactatcgctcctgagcgggctggcaaggc

SEQ ID NO: 2570 - DNA, 495 bp, Artificial Sequence
  Synthetic Template Oligonucleotide for IgH VJ Locus
gcctccctcgcgccatcagttcggaactcagatgcggcagtagcagaaaacaaaggccctagagtggccattcttacctgaggagacggtgaccgtggtccctttgccccagacgtccatgtagtagtagtagtagtcgacttcggaactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccttcggaactcagatgcctgagcgggctggcaaggc

SEQ ID NO: 2571 - DNA, 495 bp, Artificial Sequence
  Synthetic Template Oligonucleotide for IgH VJ Locus
gcctccctcgcgccatcagttcggaacgtgtagcaggcagtagcagaaaacaaaggccctagagtggccattcttacctgaggagacggtgaccgtggtccctttgccccagacgtccatgtagtagtagtagtagtcgacttcggaacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgttcggaacgtgtagcactgagcgggctggcaaggc

SEQ ID NO: 2572 - DNA, 495 bp, Artificial Sequence
  Synthetic Template Oligonucleotide for IgH VJ Locus
gcctccctcgcgccatcagttcggaactggcagttggcagtagcagaaaacaaaggccctagagtggccattcttacctgaggagacggtgaccgtggtccctttgccccagacgtccatgtagtagtagtagtagtcgacttcggaactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgttcggaactggcagttctgagcgggctggcaaggc

SEQ ID NO: 2573 - DNA, 495 bp, Artificial Sequence
  Synthetic Template Oligonucleotide for IgH VJ Locus
gcctccctcgcgccatcagttcggaaccagtccaaggcagtagcagaaaacaaaggccctagagtggccattcttacctgaggagacggtgaccgtggtccctttgccccagacgtccatgtagtagtagtagtagtcgacttcggaaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacttcggaaccagtccaactgagcgggctggcaaggc

SEQ ID NO: 2574 - DNA, 495 bp, Artificial Sequence
  Synthetic Template Oligonucleotide for IgH VJ Locus
gcctccctcgcgccatcagttcggaacgtgtctacggcagtagcagaaaacaaaggccctagagtggccattcttacctgaggagacggtgaccgtggtccctttgccccagacgtccatgtagtagtagtagtagtcgacttcggaacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggttcggaacgtgtctacctgagcgggctggcaaggc

SEQ ID NO: 2575 - DNA, 495 bp, Artificial Sequence
  Synthetic Template Oligonucleotide for IgH VJ Locus
gcctccctcgcgccatcagttcggaacgtacagtgggcagtagcagaaaacaaaggccctagagtggccattcttacctgaggagacggtgaccgtggtccctttgccccagacgtccatgtagtagtagtagtagtcgacttcggaacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagttcggaacgtacagtgctgagcgggctggcaaggc

SEQ ID NO: 2576 - DNA, 495 bp, Artificial Sequence
  Synthetic Template Oligonucleotide for IgH VJ Locus
gcctccctcgcgccatcagttcggaacggatcatcggcagtagcagaaaacaaaggccctagagtggccattcttacctgaggagacggtgaccgtggtccctttgccccagacgtccatgtagtagtagtagtagtcgacttcggaacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagttcggaacggatcatcctgagcgggctggcaaggc

SEQ ID NO: 2577 - DNA, 495 bp, Artificial Sequence
  Synthetic Template Oligonucleotide for IgH VJ Locus
gcctccctcgcgccatcagttcggaactattggcgggcagtagcagaaaacaaaggccctagagtggccattcttacctgaggagacggtgaccgtggtccctttgccccagacgtccatgtagtagtagtagtagtcgacttcggaactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcattcggaactattggcgctgagcgggctggcaaggc

SEQ ID NO: 2578 - DNA, 495 bp, Artificial Sequence
  Synthetic Template Oligonucleotide for IgH VJ Locus
gcctccctcgcgccatcagttcggaacaggcttgaggcagtagcagaaaacaaaggccctagagtggccattcttacctgaggagacggtgaccgtggtccctttgccccagacgtccatgtagtagtagtagtagtcgacttcggaacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacttcggaacaggcttgactgagcgggctggcaaggc

SEQ ID NO: 2579 - DNA, 495 bp, Artificial Sequence
  Synthetic Template Oligonucleotide for IgH VJ Locus
gcctccctcgcgccatcagttcggaacacacacgtggcagtagcagaaaacaaaggccctagagtggccattcttacctgaggagacggtgaccgtggtccctttgccccagacgtccatgtagtagtagtagtagtcgacttcggaacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatttcggaacacacacgtctgagcgggctggcaaggc

SEQ ID NO: 2580 - DNA, 495 bp, Artificial Sequence
  Synthetic Template Oligonucleotide for IgH VJ Locus
gcctccctcgcgccatcagttcggaactagacggaggcagtagcagaaaacaaaggccctagagtggccattcttacctgaggagacggtgaccgtggtccctttgccccagacgtccatgtagtagtagtagtagtcgacttcggaactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgattcggaactagacggactgagcgggctggcaaggc

SEQ ID NO: 2581 - DNA, 495 bp, Artificial Sequence
  Synthetic Template Oligonucleotide for IgH VJ Locus
gcctccctcgcgccatcagttcggaacgagcgataggcagtagcagaaaacaaaggccctagagtggccattcttacctgaggagacggtgaccgtggtccctttgccccagacgtccatgtagtagtagtagtagtcgacttcggaacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttttcggaacgagcgatactgagcgggctggcaaggc

SEQ ID NO: 2582 - DNA, 495 bp, Artificial Sequence
  Synthetic Template Oligonucleotide for IgH VJ Locus
gcctccctcgcgccatcagttcggaacgcatctgaggcagtagcagaaaacaaaggccctagagtggccattcttacctgaggagacggtgaccgtggtccctttgccccagacgtccatgtagtagtagtagtagtcgacttcggaacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacattcggaacgcatctgactgagcgggctggcaaggc

SEQ ID NO: 2583 - DNA, 495 bp, Artificial Sequence
  Synthetic Template Oligonucleotide for IgH VJ Locus
gcctccctcgcgccatcagttcggaactgctacacggcagtagcagaaaacaaaggccctagagtggccattcttacctgaggagacggtgaccgtggtccctttgccccagacgtccatgtagtagtagtagtagtcgacttcggaactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgttcggaactgctacacctgagcgggctggcaaggc

SEQ ID NO: 2584 - DNA, 495 bp, Artificial Sequence
  Synthetic Template Oligonucleotide for IgH VJ Locus
gcctccctcgcgccatcagttcggaacaactgccaggcagtagcagaaaacaaaggccctagagtggccattcttacctgaggagacggtgaccgtggtccctttgccccagacgtccatgtagtagtagtagtagtcgacttcggaacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttttcggaacaactgccactgagcgggctggcaaggc

SEQ ID NO: 2585 - DNA, 495 bp, Artificial Sequence
  Synthetic Template Oligonucleotide for IgH VJ Locus
gcctccctcgcgccatcagttcggaacttggactgggcagtagcagaaaacaaaggccctagagtggccattcttacctgaggagacggtgaccgtggtccctttgccccagacgtccatgtagtagtagtagtagtcgacttcggaacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggttcggaacttggactgctgagcgggctggcaaggc

SEQ ID NO: 2586 - DNA, 495 bp, Artificial Sequence
  Synthetic Template Oligonucleotide for IgH VJ Locus
gcctccctcgcgccatcagttcggaactcggtactggcagtagcagaaaacaaaggccctagagtggccattcttacctgaggagacggtgaccgtggtccctttgccccagacgtccatgtagtagtagtagtagtcgacttcggaactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgttcggaactcggtactctgagcgggctggcaaggc

SEQ ID NO: 2587 - DNA, 495 bp, Artificial Sequence
  Synthetic Template Oligonucleotide for IgH VJ Locus
gcctccctcgcgccatcagttcggaacccatggatggcagtagcagaaaacaaaggccctagagtggccattcttacctgaggagacggtgaccgtggtccctttgccccagacgtccatgtagtagtagtagtagtcgacttcggaacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacttcggaacccatggatctgagcgggctggcaaggc

SEQ ID NO: 2588 - DNA, 495 bp, Artificial Sequence
  Synthetic Template Oligonucleotide for IgH VJ Locus
gcctccctcgcgccatcagttcggaacacgaagatggcagtagcagaaaacaaaggccctagagtggccattcttacctgaggagacggtgaccgtggtccctttgccccagacgtccatgtagtagtagtagtagtcgacttcggaacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaattcggaacacgaagatctgagcgggctggcaaggc

SEQ ID NO: 2589 - DNA, 495 bp, Artificial Sequence
  Synthetic Template Oligonucleotide for IgH VJ Locus
gcctccctcgcgccatcagttcggaacactgtggaggcagtagcagaaaacaaaggccctagagtggccattcttacctgaggagacggtgaccgtggtccctttgccccagacgtccatgtagtagtagtagtagtcgacttcggaacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttttcggaacactgtggactgagcgggctggcaaggc

SEQ ID NO: 2590 - DNA, 495 bp, Artificial Sequence
  Synthetic Template Oligonucleotide for IgH VJ Locus
gcctccctcgcgccatcagttcggaacggtgtcatggcagtagcagaaaacaaaggccctagagtggccattcttacctgaggagacggtgaccgtggtccctttgccccagacgtccatgtagtagtagtagtagtcgacttcggaacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctttcggaacggtgtcatctgagcgggctggcaaggc

SEQ ID NO: 2591 - DNA, 495 bp, Artificial Sequence
  Synthetic Template Oligonucleotide for IgH VJ Locus
gcctccctcgcgccatcagttcggaactcgtgaagggcagtagcagaaaacaaaggccctagagtggccattcttacctgaggagacggtgaccgtggtccctttgccccagacgtccatgtagtagtagtagtagtcgacttcggaactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggttcggaactcgtgaagctgagcgggctggcaaggc

SEQ ID NO: 2592 - DNA, 495 bp, Artificial Sequence
  Synthetic Template Oligonucleotide for IgH VJ Locus
gcctccctcgcgccatcagttcggaaccactagctggcagtagcagaaaacaaaggccctagagtggccattcttacctgaggagacggtgaccgtggtccctttgccccagacgtccatgtagtagtagtagtagtcgacttcggaaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaattcggaaccactagctctgagcgggctggcaaggc

SEQ ID NO: 2593 - DNA, 495 bp, Artificial Sequence
  Synthetic Template Oligonucleotide for IgH VJ Locus
gcctccctcgcgccatcagttcggaacggtcaactggcagtagcagaaaacaaaggccctagagtggccattcttacctgaggagacggtgaccgtggtccctttgccccagacgtccatgtagtagtagtagtagtcgacttcggaacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggattcggaacggtcaactctgagcgggctggcaaggc

SEQ ID NO: 2594 - DNA, 495 bp, Artificial Sequence
  Synthetic Template Oligonucleotide for IgH VJ Locus
gcctccctcgcgccatcagttcggaactacgtacgggcagtagcagaaaacaaaggccctagagtggccattcttacctgaggagacggtgaccgtggtccctttgccccagacgtccatgtagtagtagtagtagtcgacttcggaactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcttcggaactacgtacgctgagcgggctggcaaggc

SEQ ID NO: 2595 - DNA, 495 bp, Artificial Sequence
  Synthetic Template Oligonucleotide for IgH VJ Locus
gcctccctcgcgccatcagttcggaacatgacaccggcagtagcagaaaacaaaggccctagagtggccattcttacctgaggagacggtgaccgtggtccctttgccccagacgtccatgtagtagtagtagtagtcgacttcggaacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggttcggaacatgacaccctgagcgggctggcaaggc

SEQ ID NO: 2596 - DNA, 495 bp, Artificial Sequence
  Synthetic Template Oligonucleotide for IgH VJ Locus
gcctccctcgcgccatcagttcggaaccttcacgaggcagtagcagaaaacaaaggccctagagtggccattcttacctgaggagacggtgaccgtggtccctttgccccagacgtccatgtagtagtagtagtagtcgacttcggaaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacttcggaaccttcacgactgagcgggctggcaaggc

SEQ ID NO: 2597 - DNA, 495 bp, Artificial Sequence
  Synthetic Template Oligonucleotide for IgH VJ Locus
gcctccctcgcgccatcagttcggaacagaatcagggcagtagcagaaaacaaaggccctagagtggccattcttacctgaggagacggtgaccgtggtccctttgccccagacgtccatgtagtagtagtagtagtcgacttcggaacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccttcggaacagaatcagctgagcgggctggcaaggc

SEQ ID NO: 2598 - DNA, 495 bp, Artificial Sequence
  Synthetic Template Oligonucleotide for IgH VJ Locus
gcctccctcgcgccatcagttcggaacagttatgcggcagtagcagaaaacaaaggccctagagtggccattcttacctgaggagacggtgaccgtggtccctttgccccagacgtccatgtagtagtagtagtagtcgacttcggaacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataattcggaacagttatgcctgagcgggctggcaaggc

SEQ ID NO: 2599 - DNA, 495 bp, Artificial Sequence
  Synthetic Template Oligonucleotide for IgH VJ Locus
gcctccctcgcgccatcagttcggaacaggtctcaggcagtagcagaaaacaaaggccctagagtggccattcttacctgaggagacggtgaccgtggtccctttgccccagacgtccatgtagtagtagtagtagtcgacttcggaacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccttcggaacaggtctcactgagcgggctggcaaggc

SEQ ID NO: 2600 - DNA, 495 bp, Artificial Sequence
  Synthetic Template Oligonucleotide for IgH VJ Locus
gcctccctcgcgccatcagttcggaacgtcatagtggcagtagcagaaaacaaaggccctagagtggccattcttacctgaggagacggtgaccgtggtccctttgccccagacgtccatgtagtagtagtagtagtcgacttcggaacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtttcggaacgtcatagtctgagcgggctggcaaggc

SEQ ID NO: 2601 - DNA, 495 bp, Artificial Sequence
  Synthetic Template Oligonucleotide for IgH VJ Locus
gcctccctcgcgccatcagttcggaacgtgacttgggcagtagcagaaaacaaaggccctagagtggccattcttacctgaggagacggtgaccgtggtccctttgccccagacgtccatgtagtagtagtagtagtcgacttcggaacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgttcggaacgtgacttgctgagcgggctggcaaggc

SEQ ID NO: 2602 - DNA, 495 bp, Artificial Sequence
  Synthetic Template Oligonucleotide for IgH VJ Locus
gcctccctcgcgccatcagttcggaacgattgcagggcagtagcagaaaacaaaggccctagagtggccattcttacctgaggagacggtgaccgtggtccctttgccccagacgtccatgtagtagtagtagtagtcgacttcggaacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccttcggaacgattgcagctgagcgggctggcaaggc

SEQ ID NO: 2603 - DNA, 495 bp, Artificial Sequence
  Synthetic Template Oligonucleotide for IgH VJ Locus
gcctccctcgcgccatcagttcggaacactatgacggcagtagcagaaaacaaaggccctagagtggccattcttacctgaggagacggtgaccgtggtccctttgccccagacgtccatgtagtagtagtagtagtcgacttcggaacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacttcggaacactatgacctgagcgggctggcaaggc

SEQ ID NO: 2604 - DNA, 495 bp, Artificial Sequence
  Synthetic Template Oligonucleotide for IgH VJ Locus
gcctccctcgcgccatcagttcggaacatggtcaaggcagtagcagaaaacaaaggccctagagtggccattcttacctgaggagacggtgaccgtggtccctttgccccagacgtccatgtagtagtagtagtagtcgacttcggaacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacttcggaacatggtcaactgagcgggctggcaaggc

SEQ ID NO: 2605 - DNA, 495 bp, Artificial Sequence
  Synthetic Template Oligonucleotide for IgH VJ Locus
gcctccctcgcgccatcagttcggaacgatggcttggcagtagcagaaaacaaaggccctagagtggccattcttacctgaggagacggtgaccgtggtccctttgccccagacgtccatgtagtagtagtagtagtcgacttcggaacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacttcggaacgatggcttctgagcgggctggcaaggc

SEQ ID NO: 2606 - DNA, 495 bp, Artificial Sequence
  Synthetic Template Oligonucleotide for IgH VJ Locus
gcctccctcgcgccatcagttcggaacagcatatgggcagtagcagaaaacaaaggccctagagtggccattcttacctgaggagacggtgaccgtggtccctttgccccagacgtccatgtagtagtagtagtagtcgacttcggaacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacttcggaacagcatatgctgagcgggctggcaaggc

SEQ ID NO: 2607 - DNA, 495 bp, Artificial Sequence
  Synthetic Template Oligonucleotide for IgH VJ Locus
gcctccctcgcgccatcagttcggaaccatatgctggcagtagcagaaaacaaaggccctagagtggccattcttacctgaggagacggtgaccgtggtccctttgccccagacgtccatgtagtagtagtagtagtcgacttcggaaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgttcggaaccatatgctctgagcgggctggcaaggc

SEQ ID NO: 2608 - DNA, 495 bp, Artificial Sequence
  Synthetic Template Oligonucleotide for IgH VJ Locus
gcctccctcgcgccatcagttcggaactcgtcgatggcagtagcagaaaacaaaggccctagagtggccattcttacctgaggagacggtgaccgtggtccctttgccccagacgtccatgtagtagtagtagtagtcgacttcggaactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccttcggaactcgtcgatctgagcgggctggcaaggc

SEQ ID NO: 2609 - DNA, 495 bp, Artificial Sequence
  Synthetic Template Oligonucleotide for IgH VJ Locus
gcctccctcgcgccatcagttcggaaccagtctgtggcagtagcagaaaacaaaggccctagagtggccattcttacctgaggagacggtgaccgtggtccctttgccccagacgtccatgtagtagtagtagtagtcgacttcggaaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcttcggaaccagtctgtctgagcgggctggcaaggc

SEQ ID NO: 2610 - DNA, 495 bp, Artificial Sequence
  Synthetic Template Oligonucleotide for IgH VJ Locus
gcctccctcgcgccatcagttcggaacaacgcgtaggcagtagcagaaaacaaaggccctagagtggccattcttacctgaggagacggtgaccgtggtccctttgccccagacgtccatgtagtagtagtagtagtcgacttcggaacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgttcggaacaacgcgtactgagcgggctggcaaggc

SEQ ID NO: 2611 - DNA, 495 bp, Artificial Sequence
  Synthetic Template Oligonucleotide for IgH VJ Locus
gcctccctcgcgccatcagttcggaacgtagttcgggcagtagcagaaaacaaaggccctagagtggccattcttacctgaggagacggtgaccgtggtccctttgccccagacgtccatgtagtagtagtagtagtcgacttcggaacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcttcggaacgtagttcgctgagcgggctggcaaggc

SEQ ID NO: 2612 - DNA, 495 bp, Artificial Sequence
  Synthetic Template Oligonucleotide for IgH VJ Locus
gcctccctcgcgccatcagttcggaaccgaactacggcagtagcagaaaacaaaggccctagagtggccattcttacctgaggagacggtgaccgtggtccctttgccccagacgtccatgtagtagtagtagtagtcgacttcggaaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacttcggaaccgaactacctgagcgggctggcaaggc

SEQ ID NO: 2613 - DNA, 495 bp, Artificial Sequence
  Synthetic Template Oligonucleotide for IgH VJ Locus
gcctccctcgcgccatcagttcggaacttaacgtcggcagtagcagaaaacaaaggccctagagtggccattcttacctgaggagacggtgaccgtggtccctttgccccagacgtccatgtagtagtagtagtagtcgacttcggaacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccttcggaacttaacgtcctgagcgggctggcaaggc

SEQ ID NO: 2614 - DNA, 495 bp, Artificial Sequence
  Synthetic Template Oligonucleotide for IgH VJ Locus
gcctccctcgcgccatcagttcggaacagcaacctggcagtagcagaaaacaaaggccctagagtggccattcttacctgaggagacggtgaccgtggtccctttgccccagacgtccatgtagtagtagtagtagtcgacttcggaacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacttcggaacagcaacctctgagcgggctggcaaggc

SEQ ID NO: 2615 - DNA, 495 bp, Artificial Sequence
  Synthetic Template Oligonucleotide for IgH VJ Locus
gcctccctcgcgccatcagttcggaacttctcgagggcagtagcagaaaacaaaggccctagagtggccattcttacctgaggagacggtgaccgtggtccctttgccccagacgtccatgtagtagtagtagtagtcgacttcggaacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttttcggaacttctcgagctgagcgggctggcaaggc

SEQ ID NO: 2616 - DNA, 495 bp, Artificial Sequence
  Synthetic Template Oligonucleotide for IgH VJ Locus
gcctccctcgcgccatcagttcggaacactctacgggcagtagcagaaaacaaaggccctagagtggccattcttacctgaggagacggtgaccgtggtccctttgccccagacgtccatgtagtagtagtagtagtcgacttcggaacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacttcggaacactctacgctgagcgggctggcaaggc

SEQ ID NO: 2617 - DNA, 495 bp, Artificial Sequence
  Synthetic Template Oligonucleotide for IgH VJ Locus
gcctccctcgcgccatcagttcggaactaccggaaggcagtagcagaaaacaaaggccctagagtggccattcttacctgaggagacggtgaccgtggtccctttgccccagacgtccatgtagtagtagtagtagtcgacttcggaactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccttcggaactaccggaactgagcgggctggcaaggc

SEQ ID NO: 2618 - DNA, 495 bp, Artificial Sequence
  Synthetic Template Oligonucleotide for IgH VJ Locus
gcctccctcgcgccatcagttcggaaccgaattgcggcagtagcagaaaacaaaggccctagagtggccattcttacctgaggagacggtgaccgtggtccctttgccccagacgtccatgtagtagtagtagtagtcgacttcggaaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacttcggaaccgaattgcctgagcgggctggcaaggc

SEQ ID NO: 2619 - DNA, 495 bp, Artificial Sequence
  Synthetic Template Oligonucleotide for IgH VJ Locus
gcctccctcgcgccatcagttcggaacttcgctcaggcagtagcagaaaacaaaggccctagagtggccattcttacctgaggagacggtgaccgtggtccctttgccccagacgtccatgtagtagtagtagtagtcgacttcggaacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacattcggaacttcgctcactgagcgggctggcaaggc

SEQ ID NO: 2620 - DNA, 495 bp, Artificial Sequence
  Synthetic Template Oligonucleotide for IgH VJ Locus
gcctccctcgcgccatcagttcggaacgacgttaaggcagtagcagaaaacaaaggccctagagtggccattcttacctgaggagacggtgaccgtggtccctttgccccagacgtccatgtagtagtagtagtagtcgacttcggaacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgttcggaacgacgttaactgagcgggctggcaaggc

SEQ ID NO: 2621 - DNA, 495 bp, Artificial Sequence
  Synthetic Template Oligonucleotide for IgH VJ Locus
gcctccctcgcgccatcagttcggaaccgtagagtggcagtagcagaaaacaaaggccctagagtggccattcttacctgaggagacggtgaccgtggtccctttgccccagacgtccatgtagtagtagtagtagtcgacttcggaaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcttcggaaccgtagagtctgagcgggctggcaaggc

SEQ ID NO: 2622 - DNA, 495 bp, Artificial Sequence
  Synthetic Template Oligonucleotide for IgH VJ Locus
gcctccctcgcgccatcagttcggaacttccggtaggcagtagcagaaaacaaaggccctagagtggccattcttacctgaggagacggtgaccgtggtccctttgccccagacgtccatgtagtagtagtagtagtcgacttcggaacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcttcggaacttccggtactgagcgggctggcaaggc

SEQ ID NO: 2623 - DNA, 495 bp, Artificial Sequence
  Synthetic Template Oligonucleotide for IgH VJ Locus
gcctccctcgcgccatcagttcggaacgcaattcgggcagtagcagaaaacaaaggccctagagtggccattcttacctgaggagacggtgaccgtggtccctttgccccagacgtccatgtagtagtagtagtagtcgacttcggaacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacttcggaacgcaattcgctgagcgggctggcaaggc

SEQ ID NO: 2624 - DNA, 495 bp, Artificial Sequence
  Synthetic Template Oligonucleotide for IgH VJ Locus
gcctccctcgcgccatcagttcggaactgagcgaaggcagtagcagaaaacaaaggccctagagtggccattcttacctgaggagacggtgaccgtggtccctttgccccagacgtccatgtagtagtagtagtagtcgacttcggaactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcttcggaactgagcgaactgagcgggctggcaaggc

SEQ ID NO: 2625 - DNA, 495 bp, Artificial Sequence
  Synthetic Template Oligonucleotide for IgH VJ Locus
gcctccctcgcgccatcagttcggaactactaagcggcagtagcagaaaacaaaggccctagagtggccattcttacctgaggagacggtgaccgtggtccctttgccccagacgtccatgtagtagtagtagtagtcgacttcggaactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccttcggaactactaagcctgagcgggctggcaaggc

SEQ ID NO: 2626 - DNA, 495 bp, Artificial Sequence
  Synthetic Template Oligonucleotide for IgH VJ Locus
gcctccctcgcgccatcagttcggaactggcgtatggcagtagcagaaaacaaaggccctagagtggccattcttacctgaggagacggtgaccgtggtccctttgccccagacgtccatgtagtagtagtagtagtcgacttcggaactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtttcggaactggcgtatctgagcgggctggcaaggc

SEQ ID NO: 2627 - DNA, 495 bp, Artificial Sequence
  Synthetic Template Oligonucleotide for IgH VJ Locus
gcctccctcgcgccatcagttcggaacgataaccaggcagtagcagaaaacaaaggccctagagtggccattcttacctgaggagacggtgaccgtggtccctttgccccagacgtccatgtagtagtagtagtagtcgacttcggaacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgttcggaacgataaccactgagcgggctggcaaggc

SEQ ID NO: 2628 - DNA, 495 bp, Artificial Sequence
  Synthetic Template Oligonucleotide for IgH VJ Locus
gcctccctcgcgccatcagttcggaacctagtgaaggcagtagcagaaaacaaaggccctagagtggccattcttacctgaggagacggtgaccgtggtccctttgccccagacgtccatgtagtagtagtagtagtcgacttcggaacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagttcggaacctagtgaactgagcgggctggcaaggc

SEQ ID NO: 2629 - DNA, 495 bp, Artificial Sequence
  Synthetic Template Oligonucleotide for IgH VJ Locus
gcctccctcgcgccatcagttcggaacacgttcacggcagtagcagaaaacaaaggccctagagtggccattcttacctgaggagacggtgaccgtggtccctttgccccagacgtccatgtagtagtagtagtagtcgacttcggaacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtttcggaacacgttcacctgagcgggctggcaaggc

SEQ ID NO: 2630 - DNA, 448 bp, Artificial Sequence
  Synthetic Template Oligonucleotide for IgH VJ Locus
gcctccctcgcgccatcagttcggaacattacgctggcagtagcagaaaacaaaggccctagagtggccattcttacctgaggagacggtgaccgtggtccctttgccccagacgtccatgtagtagtagtagtagtcgacttcggaacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcattcggaacattacgctctgagcgggctggcaaggc

SEQ ID NO: 2631 - DNA, 495 bp, Artificial Sequence
  Synthetic Template Oligonucleotide for IgH VJ Locus
gcctccctcgcgccatcagttcggaaccattgagtggcagtagcagaaaacaaaggccctagagtggccattcttacctgaggagacggtgaccgtggtccctttgccccagacgtccatgtagtagtagtagtagtcgacttcggaaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccttcggaaccattgagtctgagcgggctggcaaggc

SEQ ID NO: 2632 - DNA, 495 bp, Artificial Sequence
  Synthetic Template Oligonucleotide for IgH VJ Locus
gcctccctcgcgccatcagaagtaacgcttggttatcagctcagccaaaaccctgcggctggtagggggcctgtggggctgggggctgatgtggctgcggtctccagggcgggtcgggtccaggggcccccagcagtcgacaagtaacgcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccaagtaacgcttggttactgagcgggctggcaaggc

SEQ ID NO: 2633 - DNA, 495 bp, Artificial Sequence
  Synthetic Template Oligonucleotide for IgH VJ Locus
gcctccctcgcgccatcagaagtaacgacctcttgtcagctcagccaaaaccctgcggctggtagggggcctgtggggctgggggctgatgtggctgcggtctccagggcgggtcgggtccaggggcccccagcagtcgacaagtaacgacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccaagtaacgacctcttgctgagcgggctggcaaggc

SEQ ID NO: 2634 - DNA, 495 bp, Artificial Sequence
  Synthetic Template Oligonucleotide for IgH VJ Locus
gcctccctcgcgccatcagaagtaacgctgattcttcagctcagccaaaaccctgcggctggtagggggcctgtggggctgggggctgatgtggctgcggtctccagggcgggtcgggtccaggggcccccagcagtcgacaagtaacgctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccaagtaacgctgattctctgagcgggctggcaaggc

SEQ ID NO: 2635 - DNA, 495 bp, Artificial Sequence
  Synthetic Template Oligonucleotide for IgH VJ Locus
gcctccctcgcgccatcagaagtaacgagtaccgatcagctcagccaaaaccctgcggctggtagggggcctgtggggctgggggctgatgtggctgcggtctccagggcgggtcgggtccaggggcccccagcagtcgacaagtaacgagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccaagtaacgagtaccgactgagcgggctggcaaggc

SEQ ID NO: 2636 - DNA, 495 bp, Artificial Sequence
  Synthetic Template Oligonucleotide for IgH VJ Locus
gcctccctcgcgccatcagaagtaacgatccatggtcagctcagccaaaaccctgcggctggtagggggcctgtggggctgggggctgatgtggctgcggtctccagggcgggtcgggtccaggggcccccagcagtcgacaagtaacgatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccaagtaacgatccatggctgagcgggctggcaaggc

SEQ ID NO: 2637 - DNA, 495 bp, Artificial Sequence
  Synthetic Template Oligonucleotide for IgH VJ Locus
gcctccctcgcgccatcagaagtaacggtagcagttcagctcagccaaaaccctgcggctggtagggggcctgtggggctgggggctgatgtggctgcggtctccagggcgggtcgggtccaggggcccccagcagtcgacaagtaacggtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcaagtaacggtagcagtctgagcgggctggcaaggc

SEQ ID NO: 2638 - DNA, 495 bp, Artificial Sequence
  Synthetic Template Oligonucleotide for IgH VJ Locus
gcctccctcgcgccatcagaagtaacgatcttcgttcagctcagccaaaaccctgcggctggtagggggcctgtggggctgggggctgatgtggctgcggtctccagggcgggtcgggtccaggggcccccagcagtcgacaagtaacgatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccaagtaacgatcttcgtctgagcgggctggcaaggc

SEQ ID NO: 2639 - DNA, 495 bp, Artificial Sequence
  Synthetic Template Oligonucleotide for IgH VJ Locus
gcctccctcgcgccatcagaagtaacgtccacagttcagctcagccaaaaccctgcggctggtagggggcctgtggggctgggggctgatgtggctgcggtctccagggcgggtcgggtccaggggcccccagcagtcgacaagtaacgtccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccaagtaacgtccacagtctgagcgggctggcaaggc

SEQ ID NO: 2640 - DNA, 495 bp, Artificial Sequence
  Synthetic Template Oligonucleotide for IgH VJ Locus
gcctccctcgcgccatcagaagtaacgagctagtgtcagctcagccaaaaccctgcggctggtagggggcctgtggggctgggggctgatgtggctgcggtctccagggcgggtcgggtccaggggcccccagcagtcgacaagtaacgagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccaagtaacgagctagtgctgagcgggctggcaaggc

SEQ ID NO: 2641 - DNA, 495 bp, Artificial Sequence
  Synthetic Template Oligonucleotide for IgH VJ Locus
gcctccctcgcgccatcagaagtaacgtaaccaagtcagctcagccaaaaccctgcggctggtagggggcctgtggggctgggggctgatgtggctgcggtctccagggcgggtcgggtccaggggcccccagcagtcgacaagtaacgtaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccaagtaacgtaaccaagctgagcgggctggcaaggc

SEQ ID NO: 2642 - DNA, 495 bp, Artificial Sequence
  Synthetic Template Oligonucleotide for IgH VJ Locus
gcctccctcgcgccatcagaagtaacgcaagaggttcagctcagccaaaaccctgcggctggtagggggcctgtggggctgggggctgatgtggctgcggtctccagggcgggtcgggtccaggggcccccagcagtcgacaagtaacgcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccaagtaacgcaagaggtctgagcgggctggcaaggc

SEQ ID NO: 2643 - DNA, 495 bp, Artificial Sequence
  Synthetic Template Oligonucleotide for IgH VJ Locus
gcctccctcgcgccatcagaagtaacgagttgacctcagctcagccaaaaccctgcggctggtagggggcctgtggggctgggggctgatgtggctgcggtctccagggcgggtcgggtccaggggcccccagcagtcgacaagtaacgagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaaaagtaacgagttgaccctgagcgggctggcaaggc

SEQ ID NO: 2644 - DNA, 495 bp, Artificial Sequence
  Synthetic Template Oligonucleotide for IgH VJ Locus
gcctccctcgcgccatcagaagtaacgcagcatattcagctcagccaaaaccctgcggctggtagggggcctgtggggctgggggctgatgtggctgcggtctccagggcgggtcgggtccaggggcccccagcagtcgacaagtaacgcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaaaagtaacgcagcatatctgagcgggctggcaaggc

SEQ ID NO: 2645 - DNA, 495 bp, Artificial Sequence
  Synthetic Template Oligonucleotide for IgH VJ Locus
gcctccctcgcgccatcagaagtaacggcaggatttcagctcagccaaaaccctgcggctggtagggggcctgtggggctgggggctgatgtggctgcggtctccagggcgggtcgggtccaggggcccccagcagtcgacaagtaacggcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataaaagtaacggcaggattctgagcgggctggcaaggc

SEQ ID NO: 2646 - DNA, 495 bp, Artificial Sequence
  Synthetic Template Oligonucleotide for IgH VJ Locus
gcctccctcgcgccatcagaagtaacggtccattctcagctcagccaaaaccctgcggctggtagggggcctgtggggctgggggctgatgtggctgcggtctccagggcgggtcgggtccaggggcccccagcagtcgacaagtaacggtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccaagtaacggtccattcctgagcgggctggcaaggc

SEQ ID NO: 2647 - DNA, 495 bp, Artificial Sequence
  Synthetic Template Oligonucleotide for IgH VJ Locus
gcctccctcgcgccatcagaagtaacggcataacttcagctcagccaaaaccctgcggctggtagggggcctgtggggctgggggctgatgtggctgcggtctccagggcgggtcgggtccaggggcccccagcagtcgacaagtaacggcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacaagtaacggcataactctgagcgggctggcaaggc

SEQ ID NO: 2648 - DNA, 495 bp, Artificial Sequence
  Synthetic Template Oligonucleotide for IgH VJ Locus
gcctccctcgcgccatcagaagtaacgatatgctgtcagctcagccaaaaccctgcggctggtagggggcctgtggggctgggggctgatgtggctgcggtctccagggcgggtcgggtccaggggcccccagcagtcgacaagtaacgatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccaagtaacgatatgctgctgagcgggctggcaaggc

SEQ ID NO: 2649 - DNA, 495 bp, Artificial Sequence
  Synthetic Template Oligonucleotide for IgH VJ Locus
gcctccctcgcgccatcagaagtaacgaatcctgctcagctcagccaaaaccctgcggctggtagggggcctgtggggctgggggctgatgtggctgcggtctccagggcgggtcgggtccaggggcccccagcagtcgacaagtaacgaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcaagtaacgaatcctgcctgagcgggctggcaaggc

SEQ ID NO: 2650 - DNA, 495 bp, Artificial Sequence
  Synthetic Template Oligonucleotide for IgH VJ Locus
gcctccctcgcgccatcagaagtaacgtgagaccttcagctcagccaaaaccctgcggctggtagggggcctgtggggctgggggctgatgtggctgcggtctccagggcgggtcgggtccaggggcccccagcagtcgacaagtaacgtgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgaagtaacgtgagacctctgagcgggctggcaaggc

SEQ ID NO: 2651 - DNA, 495 bp, Artificial Sequence
  Synthetic Template Oligonucleotide for IgH VJ Locus
gcctccctcgcgccatcagaagtaacggaatggactcagctcagccaaaaccctgcggctggtagggggcctgtggggctgggggctgatgtggctgcggtctccagggcgggtcgggtccaggggcccccagcagtcgacaagtaacggaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccaagtaacggaatggacctgagcgggctggcaaggc

SEQ ID NO: 2652 - DNA, 495 bp, Artificial Sequence
  Synthetic Template Oligonucleotide for IgH VJ Locus
gcctccctcgcgccatcagaagtaacgcacatggatcagctcagccaaaaccctgcggctggtagggggcctgtggggctgggggctgatgtggctgcggtctccagggcgggtcgggtccaggggcccccagcagtcgacaagtaacgcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccaagtaacgcacatggactgagcgggctggcaaggc

SEQ ID NO: 2653 - DNA, 495 bp, Artificial Sequence
  Synthetic Template Oligonucleotide for IgH VJ Locus
gcctccctcgcgccatcagaagtaacgttgaccattcagctcagccaaaaccctgcggctggtagggggcctgtggggctgggggctgatgtggctgcggtctccagggcgggtcgggtccaggggcccccagcagtcgacaagtaacgttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccaagtaacgttgaccatctgagcgggctggcaaggc

SEQ ID NO: 2654 - DNA, 495 bp, Artificial Sequence
  Synthetic Template Oligonucleotide for IgH VJ Locus
gcctccctcgcgccatcagaagtaacgaagccatctcagctcagccaaaaccctgcggctggtagggggcctgtggggctgggggctgatgtggctgcggtctccagggcgggtcgggtccaggggcccccagcagtcgacaagtaacgaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccaagtaacgaagccatcctgagcgggctggcaaggc

SEQ ID NO: 2655 - DNA, 495 bp, Artificial Sequence
  Synthetic Template Oligonucleotide for IgH VJ Locus
gcctccctcgcgccatcagaagtaacgtccatgtgtcagctcagccaaaaccctgcggctggtagggggcctgtggggctgggggctgatgtggctgcggtctccagggcgggtcgggtccaggggcccccagcagtcgacaagtaacgtccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccaagtaacgtccatgtgctgagcgggctggcaaggc

SEQ ID NO: 2656 - DNA, 495 bp, Artificial Sequence
  Synthetic Template Oligonucleotide for IgH VJ Locus
gcctccctcgcgccatcagaagtaacgcaagtcactcagctcagccaaaaccctgcggctggtagggggcctgtggggctgggggctgatgtggctgcggtctccagggcgggtcgggtccaggggcccccagcagtcgacaagtaacgcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccaagtaacgcaagtcacctgagcgggctggcaaggc

SEQ ID NO: 2657 - DNA, 495 bp, Artificial Sequence
  Synthetic Template Oligonucleotide for IgH VJ Locus
gcctccctcgcgccatcagaagtaacgctgcaatctcagctcagccaaaaccctgcggctggtagggggcctgtggggctgggggctgatgtggctgcggtctccagggcgggtcgggtccaggggcccccagcagtcgacaagtaacgctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccaagtaacgctgcaatcctgagcgggctggcaaggc

SEQ ID NO: 2658 - DNA, 495 bp, Artificial Sequence
  Synthetic Template Oligonucleotide for IgH VJ Locus
gcctccctcgcgccatcagaagtaacgatcgacgatcagctcagccaaaaccctgcggctggtagggggcctgtggggctgggggctgatgtggctgcggtctccagggcgggtcgggtccaggggcccccagcagtcgacaagtaacgatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccaagtaacgatcgacgactgagcgggctggcaaggc

SEQ ID NO: 2659 - DNA, 495 bp, Artificial Sequence
  Synthetic Template Oligonucleotide for IgH VJ Locus
gcctccctcgcgccatcagaagtaacgacagactgtcagctcagccaaaaccctgcggctggtagggggcctgtggggctgggggctgatgtggctgcggtctccagggcgggtcgggtccaggggcccccagcagtcgacaagtaacgacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaaaagtaacgacagactgctgagcgggctggcaaggc

SEQ ID NO: 2660 - DNA, 495 bp, Artificial Sequence
  Synthetic Template Oligonucleotide for IgH VJ Locus
gcctccctcgcgccatcagaagtaacgccttatagtcagctcagccaaaaccctgcggctggtagggggcctgtggggctgggggctgatgtggctgcggtctccagggcgggtcgggtccaggggcccccagcagtcgacaagtaacgccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacaagtaacgccttatagctgagcgggctggcaaggc

SEQ ID NO: 2661 - DNA, 495 bp, Artificial Sequence
  Synthetic Template Oligonucleotide for IgH VJ Locus
gcctccctcgcgccatcagaagtaacgtacgcgtttcagctcagccaaaaccctgcggctggtagggggcctgtggggctgggggctgatgtggctgcggtctccagggcgggtcgggtccaggggcccccagcagtcgacaagtaacgtacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccaagtaacgtacgcgttctgagcgggctggcaaggc

SEQ ID NO: 2662 - DNA, 495 bp, Artificial Sequence
  Synthetic Template Oligonucleotide for IgH VJ Locus
gcctccctcgcgccatcagaagtaacgctataaggtcagctcagccaaaaccctgcggctggtagggggcctgtggggctgggggctgatgtggctgcggtctccagggcgggtcgggtccaggggcccccagcagtcgacaagtaacgctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgaagtaacgctataaggctgagcgggctggcaaggc

SEQ ID NO: 2663 - DNA, 495 bp, Artificial Sequence
  Synthetic Template Oligonucleotide for IgH VJ Locus
gcctccctcgcgccatcagaagtaacgtcttagtctcagctcagccaaaaccctgcggctggtagggggcctgtggggctgggggctgatgtggctgcggtctccagggcgggtcgggtccaggggcccccagcagtcgacaagtaacgtcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcaagtaacgtcttagtcctgagcgggctggcaaggc

SEQ ID NO: 2664 - DNA, 495 bp, Artificial Sequence
  Synthetic Template Oligonucleotide for IgH VJ Locus
gcctccctcgcgccatcagaagtaacgtgtctgcatcagctcagccaaaaccctgcggctggtagggggcctgtggggctgggggctgatgtggctgcggtctccagggcgggtcgggtccaggggcccccagcagtcgacaagtaacgtgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccaagtaacgtgtctgcactgagcgggctggcaaggc

SEQ ID NO: 2665 - DNA, 495 bp, Artificial Sequence
  Synthetic Template Oligonucleotide for IgH VJ Locus
gcctccctcgcgccatcagaagtaacggccattaatcagctcagccaaaaccctgcggctggtagggggcctgtggggctgggggctgatgtggctgcggtctccagggcgggtcgggtccaggggcccccagcagtcgacaagtaacggccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcaagtaacggccattaactgagcgggctggcaaggc

SEQ ID NO: 2666 - DNA, 495 bp, Artificial Sequence
  Synthetic Template Oligonucleotide for IgH VJ Locus
gcctccctcgcgccatcagaagtaacggactaagatcagctcagccaaaaccctgcggctggtagggggcctgtggggctgggggctgatgtggctgcggtctccagggcgggtcgggtccaggggcccccagcagtcgacaagtaacggactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgaagtaacggactaagactgagcgggctggcaaggc

SEQ ID NO: 2667 - DNA, 495 bp, Artificial Sequence
  Synthetic Template Oligonucleotide for IgH VJ Locus
gcctccctcgcgccatcagaagtaacgaggttgcttcagctcagccaaaaccctgcggctggtagggggcctgtggggctgggggctgatgtggctgcggtctccagggcgggtcgggtccaggggcccccagcagtcgacaagtaacgaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgaagtaacgaggttgctctgagcgggctggcaaggc

SEQ ID NO: 2668 - DNA, 495 bp, Artificial Sequence
  Synthetic Template Oligonucleotide for IgH VJ Locus
gcctccctcgcgccatcagaagtaacgctcgagaatcagctcagccaaaaccctgcggctggtagggggcctgtggggctgggggctgatgtggctgcggtctccagggcgggtcgggtccaggggcccccagcagtcgacaagtaacgctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccaagtaacgctcgagaactgagcgggctggcaaggc

SEQ ID NO: 2669 - DNA, 495 bp, Artificial Sequence
  Synthetic Template Oligonucleotide for IgH VJ Locus
gcctccctcgcgccatcagaagtaacgttaatggctcagctcagccaaaaccctgcggctggtagggggcctgtggggctgggggctgatgtggctgcggtctccagggcgggtcgggtccaggggcccccagcagtcgacaagtaacgttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccaagtaacgttaatggcctgagcgggctggcaaggc

SEQ ID NO: 2670 - DNA, 495 bp, Artificial Sequence
  Synthetic Template Oligonucleotide for IgH VJ Locus
gcctccctcgcgccatcagaagtaacgtgcagacatcagctcagccaaaaccctgcggctggtagggggcctgtggggctgggggctgatgtggctgcggtctccagggcgggtcgggtccaggggcccccagcagtcgacaagtaacgtgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaaaagtaacgtgcagacactgagcgggctggcaaggc

SEQ ID NO: 2671 - DNA, 495 bp, Artificial Sequence
  Synthetic Template Oligonucleotide for IgH VJ Locus
gcctccctcgcgccatcagaagtaacgtcactgagtcagctcagccaaaaccctgcggctggtagggggcctgtggggctgggggctgatgtggctgcggtctccagggcgggtcgggtccaggggcccccagcagtcgacaagtaacgtcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtaagtaacgtcactgagctgagcgggctggcaaggc

SEQ ID NO: 2672 - DNA, 495 bp, Artificial Sequence
  Synthetic Template Oligonucleotide for IgH VJ Locus
gcctccctcgcgccatcagaagtaacggagtacgttcagctcagccaaaaccctgcggctggtagggggcctgtggggctgggggctgatgtggctgcggtctccagggcgggtcgggtccaggggcccccagcagtcgacaagtaacggagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacaagtaacggagtacgtctgagcgggctggcaaggc

SEQ ID NO: 2673 - DNA, 495 bp, Artificial Sequence
  Synthetic Template Oligonucleotide for IgH VJ Locus
gcctccctcgcgccatcagaagtaacgatacgccatcagctcagccaaaaccctgcggctggtagggggcctgtggggctgggggctgatgtggctgcggtctccagggcgggtcgggtccaggggcccccagcagtcgacaagtaacgatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacaagtaacgatacgccactgagcgggctggcaaggc

SEQ ID NO: 2674 - DNA, 495 bp, Artificial Sequence
  Synthetic Template Oligonucleotide for IgH VJ Locus
gcctccctcgcgccatcagaagtaacgtcgcatcatcagctcagccaaaaccctgcggctggtagggggcctgtggggctgggggctgatgtggctgcggtctccagggcgggtcgggtccaggggcccccagcagtcgacaagtaacgtcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacaagtaacgtcgcatcactgagcgggctggcaaggc

SEQ ID NO: 2675 - DNA, 495 bp, Artificial Sequence
  Synthetic Template Oligonucleotide for IgH VJ Locus
gcctccctcgcgccatcagaagtaacgcgcttaattcagctcagccaaaaccctgcggctggtagggggcctgtggggctgggggctgatgtggctgcggtctccagggcgggtcgggtccaggggcccccagcagtcgacaagtaacgcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacaagtaacgcgcttaatctgagcgggctggcaaggc

SEQ ID NO: 2676 - DNA, 495 bp, Artificial Sequence
  Synthetic Template Oligonucleotide for IgH VJ Locus
gcctccctcgcgccatcagaagtaacgtggttatctcagctcagccaaaaccctgcggctggtagggggcctgtggggctgggggctgatgtggctgcggtctccagggcgggtcgggtccaggggcccccagcagtcgacaagtaacgtggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtaagtaacgtggttatcctgagcgggctggcaaggc

SEQ ID NO: 2677 - DNA, 495 bp, Artificial Sequence
  Synthetic Template Oligonucleotide for IgH VJ Locus
gcctccctcgcgccatcagaagtaacgggattgcttcagctcagccaaaaccctgcggctggtagggggcctgtggggctgggggctgatgtggctgcggtctccagggcgggtcgggtccaggggcccccagcagtcgacaagtaacgggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacaagtaacgggattgctctgagcgggctggcaaggc

SEQ ID NO: 2678 - DNA, 495 bp, Artificial Sequence
  Synthetic Template Oligonucleotide for IgH VJ Locus
gcctccctcgcgccatcagaagtaacgctcagtgatcagctcagccaaaaccctgcggctggtagggggcctgtggggctgggggctgatgtggctgcggtctccagggcgggtcgggtccaggggcccccagcagtcgacaagtaacgctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtaagtaacgctcagtgactgagcgggctggcaaggc

SEQ ID NO: 2679 - DNA, 495 bp, Artificial Sequence
  Synthetic Template Oligonucleotide for IgH VJ Locus
gcctccctcgcgccatcagaagtaacgacgtactctcagctcagccaaaaccctgcggctggtagggggcctgtggggctgggggctgatgtggctgcggtctccagggcgggtcgggtccaggggcccccagcagtcgacaagtaacgacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacaagtaacgacgtactcctgagcgggctggcaaggc

SEQ ID NO: 2680 - DNA, 495 bp, Artificial Sequence
  Synthetic Template Oligonucleotide for IgH VJ Locus
gcctccctcgcgccatcagaagtaacgtgatgcgatcagctcagccaaaaccctgcggctggtagggggcctgtggggctgggggctgatgtggctgcggtctccagggcgggtcgggtccaggggcccccagcagtcgacaagtaacgtgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccaagtaacgtgatgcgactgagcgggctggcaaggc

SEQ ID NO: 2681 - DNA, 495 bp, Artificial Sequence
  Synthetic Template Oligonucleotide for IgH VJ Locus
gcctccctcgcgccatcagaagtaacgattaagcgtcagctcagccaaaaccctgcggctggtagggggcctgtggggctgggggctgatgtggctgcggtctccagggcgggtcgggtccaggggcccccagcagtcgacaagtaacgattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccaagtaacgattaagcgctgagcgggctggcaaggc

SEQ ID NO: 2682 - DNA, 495 bp, Artificial Sequence
  Synthetic Template Oligonucleotide for IgH VJ Locus
gcctccctcgcgccatcagaagtaacgagcaatcctcagctcagccaaaaccctgcggctggtagggggcctgtggggctgggggctgatgtggctgcggtctccagggcgggtcgggtccaggggcccccagcagtcgacaagtaacgagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccaagtaacgagcaatccctgagcgggctggcaaggc

SEQ ID NO: 2683 - DNA, 495 bp, Artificial Sequence
  Synthetic Template Oligonucleotide for IgH VJ Locus
gcctccctcgcgccatcagaagtaacggcttagtatcagctcagccaaaaccctgcggctggtagggggcctgtggggctgggggctgatgtggctgcggtctccagggcgggtcgggtccaggggcccccagcagtcgacaagtaacggcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgaaagtaacggcttagtactgagcgggctggcaaggc

SEQ ID NO: 2684 - DNA, 495 bp, Artificial Sequence
  Synthetic Template Oligonucleotide for IgH VJ Locus
gcctccctcgcgccatcagaagtaacgtgaccttgtcagctcagccaaaaccctgcggctggtagggggcctgtggggctgggggctgatgtggctgcggtctccagggcgggtcgggtccaggggcccccagcagtcgacaagtaacgtgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccaagtaacgtgaccttgctgagcgggctggcaaggc

SEQ ID NO: 2685 - DNA, 495 bp, Artificial Sequence
  Synthetic Template Oligonucleotide for IgH VJ Locus
gcctccctcgcgccatcagaagtaacgcaaggtcatcagctcagccaaaaccctgcggctggtagggggcctgtggggctgggggctgatgtggctgcggtctccagggcgggtcgggtccaggggcccccagcagtcgacaagtaacgcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccaagtaacgcaaggtcactgagcgggctggcaaggc

SEQ ID NO: 2686 - DNA, 495 bp, Artificial Sequence
  Synthetic Template Oligonucleotide for IgH VJ Locus
gcctccctcgcgccatcagaagtaacgcactgtactcagctcagccaaaaccctgcggctggtagggggcctgtggggctgggggctgatgtggctgcggtctccagggcgggtcgggtccaggggcccccagcagtcgacaagtaacgcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcaagtaacgcactgtacctgagcgggctggcaaggc

SEQ ID NO: 2687 - DNA, 495 bp, Artificial Sequence
  Synthetic Template Oligonucleotide for IgH VJ Locus
gcctccctcgcgccatcagaagtaacggatgatcctcagctcagccaaaaccctgcggctggtagggggcctgtggggctgggggctgatgtggctgcggtctccagggcgggtcgggtccaggggcccccagcagtcgacaagtaacggatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggaagtaacggatgatccctgagcgggctggcaaggc

SEQ ID NO: 2688 - DNA, 495 bp, Artificial Sequence
  Synthetic Template Oligonucleotide for IgH VJ Locus
gcctccctcgcgccatcagaagtaacgcgccaatatcagctcagccaaaaccctgcggctggtagggggcctgtggggctgggggctgatgtggctgcggtctccagggcgggtcgggtccaggggcccccagcagtcgacaagtaacgcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggaagtaacgcgccaatactgagcgggctggcaaggc

SEQ ID NO: 2689 - DNA, 495 bp, Artificial Sequence
  Synthetic Template Oligonucleotide for IgH VJ Locus
gcctccctcgcgccatcagaagtaacgtcaagccttcagctcagccaaaaccctgcggctggtagggggcctgtggggctgggggctgatgtggctgcggtctccagggcgggtcgggtccaggggcccccagcagtcgacaagtaacgtcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacaaagtaacgtcaagcctctgagcgggctggcaaggc

SEQ ID NO: 2690 - DNA, 495 bp, Artificial Sequence
  Synthetic Template Oligonucleotide for IgH VJ Locus
gcctccctcgcgccatcagaagtaacgacgtgtgttcagctcagccaaaaccctgcggctggtagggggcctgtggggctgggggctgatgtggctgcggtctccagggcgggtcgggtccaggggcccccagcagtcgacaagtaacgacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagaagtaacgacgtgtgtctgagcgggctggcaaggc

SEQ ID NO: 2691 - DNA, 495 bp, Artificial Sequence
  Synthetic Template Oligonucleotide for IgH VJ Locus
gcctccctcgcgccatcagaagtaacgtccgtctatcagctcagccaaaaccctgcggctggtagggggcctgtggggctgggggctgatgtggctgcggtctccagggcgggtcgggtccaggggcccccagcagtcgacaagtaacgtccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagaagtaacgtccgtctactgagcgggctggcaaggc

SEQ ID NO: 2692 - DNA, 495 bp, Artificial Sequence
  Synthetic Template Oligonucleotide for IgH VJ Locus
gcctccctcgcgccatcagaagtaacgaagagctgtcagctcagccaaaaccctgcggctggtagggggcctgtggggctgggggctgatgtggctgcggtctccagggcgggtcgggtccaggggcccccagcagtcgacaagtaacgaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgaagtaacgaagagctgctgagcgggctggcaaggc

SEQ ID NO: 2693 - DNA, 495 bp, Artificial Sequence
  Synthetic Template Oligonucleotide for IgH VJ Locus
gcctccctcgcgccatcagaagtaacgtatcgctctcagctcagccaaaaccctgcggctggtagggggcctgtggggctgggggctgatgtggctgcggtctccagggcgggtcgggtccaggggcccccagcagtcgacaagtaacgtatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagaagtaacgtatcgctcctgagcgggctggcaaggc

SEQ ID NO: 2694 - DNA, 495 bp, Artificial Sequence
  Synthetic Template Oligonucleotide for IgH VJ Locus
gcctccctcgcgccatcagaagtaacgtcagatgctcagctcagccaaaaccctgcggctggtagggggcctgtggggctgggggctgatgtggctgcggtctccagggcgggtcgggtccaggggcccccagcagtcgacaagtaacgtcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccaagtaacgtcagatgcctgagcgggctggcaaggc

SEQ ID NO: 2695 - DNA, 495 bp, Artificial Sequence
  Synthetic Template Oligonucleotide for IgH VJ Locus
gcctccctcgcgccatcagaagtaacggtgtagcatcagctcagccaaaaccctgcggctggtagggggcctgtggggctgggggctgatgtggctgcggtctccagggcgggtcgggtccaggggcccccagcagtcgacaagtaacggtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgaagtaacggtgtagcactgagcgggctggcaaggc

SEQ ID NO: 2696 - DNA, 495 bp, Artificial Sequence
  Synthetic Template Oligonucleotide for IgH VJ Locus
gcctccctcgcgccatcagaagtaacgtggcagtttcagctcagccaaaaccctgcggctggtagggggcctgtggggctgggggctgatgtggctgcggtctccagggcgggtcgggtccaggggcccccagcagtcgacaagtaacgtggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgaagtaacgtggcagttctgagcgggctggcaaggc

SEQ ID NO: 2697 - DNA, 495 bp, Artificial Sequence
  Synthetic Template Oligonucleotide for IgH VJ Locus
gcctccctcgcgccatcagaagtaacgcagtccaatcagctcagccaaaaccctgcggctggtagggggcctgtggggctgggggctgatgtggctgcggtctccagggcgggtcgggtccaggggcccccagcagtcgacaagtaacgcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacaagtaacgcagtccaactgagcgggctggcaaggc

SEQ ID NO: 2698 - DNA, 495 bp, Artificial Sequence
  Synthetic Template Oligonucleotide for IgH VJ Locus
gcctccctcgcgccatcagaagtaacggtgtctactcagctcagccaaaaccctgcggctggtagggggcctgtggggctgggggctgatgtggctgcggtctccagggcgggtcgggtccaggggcccccagcagtcgacaagtaacggtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggaagtaacggtgtctacctgagcgggctggcaaggc

SEQ ID NO: 2699 - DNA, 495 bp, Artificial Sequence
  Synthetic Template Oligonucleotide for IgH VJ Locus
gcctccctcgcgccatcagaagtaacggtacagtgtcagctcagccaaaaccctgcggctggtagggggcctgtggggctgggggctgatgtggctgcggtctccagggcgggtcgggtccaggggcccccagcagtcgacaagtaacggtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagaagtaacggtacagtgctgagcgggctggcaaggc

SEQ ID NO: 2700 - DNA, 495 bp, Artificial Sequence
  Synthetic Template Oligonucleotide for IgH VJ Locus
gcctccctcgcgccatcagaagtaacgggatcatctcagctcagccaaaaccctgcggctggtagggggcctgtggggctgggggctgatgtggctgcggtctccagggcgggtcgggtccaggggcccccagcagtcgacaagtaacgggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagaagtaacgggatcatcctgagcgggctggcaaggc

SEQ ID NO: 2701 - DNA, 495 bp, Artificial Sequence
  Synthetic Template Oligonucleotide for IgH VJ Locus
gcctccctcgcgccatcagaagtaacgtattggcgtcagctcagccaaaaccctgcggctggtagggggcctgtggggctgggggctgatgtggctgcggtctccagggcgggtcgggtccaggggcccccagcagtcgacaagtaacgtattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcaaagtaacgtattggcgctgagcgggctggcaaggc

SEQ ID NO: 2702 - DNA, 495 bp, Artificial Sequence
  Synthetic Template Oligonucleotide for IgH VJ Locus
gcctccctcgcgccatcagaagtaacgaggcttgatcagctcagccaaaaccctgcggctggtagggggcctgtggggctgggggctgatgtggctgcggtctccagggcgggtcgggtccaggggcccccagcagtcgacaagtaacgaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacaagtaacgaggcttgactgagcgggctggcaaggc

SEQ ID NO: 2703 - DNA, 495 bp, Artificial Sequence
  Synthetic Template Oligonucleotide for IgH VJ Locus
gcctccctcgcgccatcagaagtaacgacacacgttcagctcagccaaaaccctgcggctggtagggggcctgtggggctgggggctgatgtggctgcggtctccagggcgggtcgggtccaggggcccccagcagtcgacaagtaacgacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcataagtaacgacacacgtctgagcgggctggcaaggc

SEQ ID NO: 2704 - DNA, 495 bp, Artificial Sequence
  Synthetic Template Oligonucleotide for IgH VJ Locus
gcctccctcgcgccatcagaagtaacgtagacggatcagctcagccaaaaccctgcggctggtagggggcctgtggggctgggggctgatgtggctgcggtctccagggcgggtcgggtccaggggcccccagcagtcgacaagtaacgtagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaaagtaacgtagacggactgagcgggctggcaaggc

SEQ ID NO: 2705 - DNA, 495 bp, Artificial Sequence
  Synthetic Template Oligonucleotide for IgH VJ Locus
gcctccctcgcgccatcagaagtaacggagcgatatcagctcagccaaaaccctgcggctggtagggggcctgtggggctgggggctgatgtggctgcggtctccagggcgggtcgggtccaggggcccccagcagtcgacaagtaacggagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttaagtaacggagcgatactgagcgggctggcaaggc

SEQ ID NO: 2706 - DNA, 495 bp, Artificial Sequence
  Synthetic Template Oligonucleotide for IgH VJ Locus
gcctccctcgcgccatcagaagtaacggcatctgatcagctcagccaaaaccctgcggctggtagggggcctgtggggctgggggctgatgtggctgcggtctccagggcgggtcgggtccaggggcccccagcagtcgacaagtaacggcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacaaagtaacggcatctgactgagcgggctggcaaggc

SEQ ID NO: 2707 - DNA, 495 bp, Artificial Sequence
  Synthetic Template Oligonucleotide for IgH VJ Locus
gcctccctcgcgccatcagaagtaacgtgctacactcagctcagccaaaaccctgcggctggtagggggcctgtggggctgggggctgatgtggctgcggtctccagggcgggtcgggtccaggggcccccagcagtcgacaagtaacgtgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgaagtaacgtgctacacctgagcgggctggcaaggc

SEQ ID NO: 2708 - DNA, 495 bp, Artificial Sequence
  Synthetic Template Oligonucleotide for IgH VJ Locus
gcctccctcgcgccatcagaagtaacgaactgccatcagctcagccaaaaccctgcggctggtagggggcctgtggggctgggggctgatgtggctgcggtctccagggcgggtcgggtccaggggcccccagcagtcgacaagtaacgaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttaagtaacgaactgccactgagcgggctggcaaggc

SEQ ID NO: 2709 - DNA, 495 bp, Artificial Sequence
  Synthetic Template Oligonucleotide for IgH VJ Locus
gcctccctcgcgccatcagaagtaacgttggactgtcagctcagccaaaaccctgcggctggtagggggcctgtggggctgggggctgatgtggctgcggtctccagggcgggtcgggtccaggggcccccagcagtcgacaagtaacgttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggaagtaacgttggactgctgagcgggctggcaaggc

SEQ ID NO: 2710 - DNA, 495 bp, Artificial Sequence
  Synthetic Template Oligonucleotide for IgH VJ Locus
gcctccctcgcgccatcagaagtaacgtcggtacttcagctcagccaaaaccctgcggctggtagggggcctgtggggctgggggctgatgtggctgcggtctccagggcgggtcgggtccaggggcccccagcagtcgacaagtaacgtcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgaagtaacgtcggtactctgagcgggctggcaaggc

SEQ ID NO: 2711 - DNA, 495 bp, Artificial Sequence
  Synthetic Template Oligonucleotide for IgH VJ Locus
gcctccctcgcgccatcagaagtaacgccatggattcagctcagccaaaaccctgcggctggtagggggcctgtggggctgggggctgatgtggctgcggtctccagggcgggtcgggtccaggggcccccagcagtcgacaagtaacgccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacaagtaacgccatggatctgagcgggctggcaaggc

SEQ ID NO: 2712 - DNA, 495 bp, Artificial Sequence
  Synthetic Template Oligonucleotide for IgH VJ Locus
gcctccctcgcgccatcagaagtaacgacgaagattcagctcagccaaaaccctgcggctggtagggggcctgtggggctgggggctgatgtggctgcggtctccagggcgggtcgggtccaggggcccccagcagtcgacaagtaacgacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaaaagtaacgacgaagatctgagcgggctggcaaggc

SEQ ID NO: 2713 - DNA, 495 bp, Artificial Sequence
  Synthetic Template Oligonucleotide for IgH VJ Locus
gcctccctcgcgccatcagaagtaacgactgtggatcagctcagccaaaaccctgcggctggtagggggcctgtggggctgggggctgatgtggctgcggtctccagggcgggtcgggtccaggggcccccagcagtcgacaagtaacgactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttaagtaacgactgtggactgagcgggctggcaaggc

SEQ ID NO: 2714 - DNA, 495 bp, Artificial Sequence
  Synthetic Template Oligonucleotide for IgH VJ Locus
gcctccctcgcgccatcagaagtaacgggtgtcattcagctcagccaaaaccctgcggctggtagggggcctgtggggctgggggctgatgtggctgcggtctccagggcgggtcgggtccaggggcccccagcagtcgacaagtaacgggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctaagtaacgggtgtcatctgagcgggctggcaaggc

SEQ ID NO: 2715 - DNA, 495 bp, Artificial Sequence
  Synthetic Template Oligonucleotide for IgH VJ Locus
gcctccctcgcgccatcagaagtaacgtcgtgaagtcagctcagccaaaaccctgcggctggtagggggcctgtggggctgggggctgatgtggctgcggtctccagggcgggtcgggtccaggggcccccagcagtcgacaagtaacgtcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggaagtaacgtcgtgaagctgagcgggctggcaaggc

SEQ ID NO: 2716 - DNA, 495 bp, Artificial Sequence
  Synthetic Template Oligonucleotide for IgH VJ Locus
gcctccctcgcgccatcagaagtaacgcactagcttcagctcagccaaaaccctgcggctggtagggggcctgtggggctgggggctgatgtggctgcggtctccagggcgggtcgggtccaggggcccccagcagtcgacaagtaacgcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaaaagtaacgcactagctctgagcgggctggcaaggc

SEQ ID NO: 2717 - DNA, 495 bp, Artificial Sequence
  Synthetic Template Oligonucleotide for IgH VJ Locus
gcctccctcgcgccatcagaagtaacgggtcaacttcagctcagccaaaaccctgcggctggtagggggcctgtggggctgggggctgatgtggctgcggtctccagggcgggtcgggtccaggggcccccagcagtcgacaagtaacgggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggaaagtaacgggtcaactctgagcgggctggcaaggc

SEQ ID NO: 2718 - DNA, 495 bp, Artificial Sequence
  Synthetic Template Oligonucleotide for IgH VJ Locus
gcctccctcgcgccatcagaagtaacgtacgtacgtcagctcagccaaaaccctgcggctggtagggggcctgtggggctgggggctgatgtggctgcggtctccagggcgggtcgggtccaggggcccccagcagtcgacaagtaacgtacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcaagtaacgtacgtacgctgagcgggctggcaaggc

SEQ ID NO: 2719 - DNA, 495 bp, Artificial Sequence
  Synthetic Template Oligonucleotide for IgH VJ Locus
gcctccctcgcgccatcagaagtaacgatgacacctcagctcagccaaaaccctgcggctggtagggggcctgtggggctgggggctgatgtggctgcggtctccagggcgggtcgggtccaggggcccccagcagtcgacaagtaacgatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggaagtaacgatgacaccctgagcgggctggcaaggc

SEQ ID NO: 2720 - DNA, 495 bp, Artificial Sequence
  Synthetic Template Oligonucleotide for IgH VJ Locus
gcctccctcgcgccatcagaagtaacgcttcacgatcagctcagccaaaaccctgcggctggtagggggcctgtggggctgggggctgatgtggctgcggtctccagggcgggtcgggtccaggggcccccagcagtcgacaagtaacgcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacaagtaacgcttcacgactgagcgggctggcaaggc

SEQ ID NO: 2721 - DNA, 495 bp, Artificial Sequence
  Synthetic Template Oligonucleotide for IgH VJ Locus
gcctccctcgcgccatcagaagtaacgagaatcagtcagctcagccaaaaccctgcggctggtagggggcctgtggggctgggggctgatgtggctgcggtctccagggcgggtcgggtccaggggcccccagcagtcgacaagtaacgagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccaagtaacgagaatcagctgagcgggctggcaaggc

SEQ ID NO: 2722 - DNA, 495 bp, Artificial Sequence
  Synthetic Template Oligonucleotide for IgH VJ Locus
gcctccctcgcgccatcagaagtaacgagttatgctcagctcagccaaaaccctgcggctggtagggggcctgtggggctgggggctgatgtggctgcggtctccagggcgggtcgggtccaggggcccccagcagtcgacaagtaacgagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataaaagtaacgagttatgcctgagcgggctggcaaggc

SEQ ID NO: 2723 - DNA, 495 bp, Artificial Sequence
  Synthetic Template Oligonucleotide for IgH VJ Locus
gcctccctcgcgccatcagaagtaacgaggtctcatcagctcagccaaaaccctgcggctggtagggggcctgtggggctgggggctgatgtggctgcggtctccagggcgggtcgggtccaggggcccccagcagtcgacaagtaacgaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccaagtaacgaggtctcactgagcgggctggcaaggc

SEQ ID NO: 2724 - DNA, 495 bp, Artificial Sequence
  Synthetic Template Oligonucleotide for IgH VJ Locus
gcctccctcgcgccatcagaagtaacggtcatagttcagctcagccaaaaccctgcggctggtagggggcctgtggggctgggggctgatgtggctgcggtctccagggcgggtcgggtccaggggcccccagcagtcgacaagtaacggtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtaagtaacggtcatagtctgagcgggctggcaaggc

SEQ ID NO: 2725 - DNA, 495 bp, Artificial Sequence
  Synthetic Template Oligonucleotide for IgH VJ Locus
gcctccctcgcgccatcagaagtaacggtgacttgtcagctcagccaaaaccctgcggctggtagggggcctgtggggctgggggctgatgtggctgcggtctccagggcgggtcgggtccaggggcccccagcagtcgacaagtaacggtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgaagtaacggtgacttgctgagcgggctggcaaggc

SEQ ID NO: 2726 - DNA, 495 bp, Artificial Sequence
  Synthetic Template Oligonucleotide for IgH VJ Locus
gcctccctcgcgccatcagaagtaacggattgcagtcagctcagccaaaaccctgcggctggtagggggcctgtggggctgggggctgatgtggctgcggtctccagggcgggtcgggtccaggggcccccagcagtcgacaagtaacggattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccaagtaacggattgcagctgagcgggctggcaaggc

SEQ ID NO: 2727 - DNA, 495 bp, Artificial Sequence
  Synthetic Template Oligonucleotide for IgH VJ Locus
gcctccctcgcgccatcagaagtaacgactatgactcagctcagccaaaaccctgcggctggtagggggcctgtggggctgggggctgatgtggctgcggtctccagggcgggtcgggtccaggggcccccagcagtcgacaagtaacgactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacaagtaacgactatgacctgagcgggctggcaaggc

SEQ ID NO: 2728 - DNA, 495 bp, Artificial Sequence
  Synthetic Template Oligonucleotide for IgH VJ Locus
gcctccctcgcgccatcagaagtaacgatggtcaatcagctcagccaaaaccctgcggctggtagggggcctgtggggctgggggctgatgtggctgcggtctccagggcgggtcgggtccaggggcccccagcagtcgacaagtaacgatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacaagtaacgatggtcaactgagcgggctggcaaggc

SEQ ID NO: 2729 - DNA, 495 bp, Artificial Sequence
  Synthetic Template Oligonucleotide for IgH VJ Locus
gcctccctcgcgccatcagaagtaacggatggctttcagctcagccaaaaccctgcggctggtagggggcctgtggggctgggggctgatgtggctgcggtctccagggcgggtcgggtccaggggcccccagcagtcgacaagtaacggatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacaagtaacggatggcttctgagcgggctggcaaggc

SEQ ID NO: 2730 - DNA, 495 bp, Artificial Sequence
  Synthetic Template Oligonucleotide for IgH VJ Locus
gcctccctcgcgccatcagaagtaacgagcatatgtcagctcagccaaaaccctgcggctggtagggggcctgtggggctgggggctgatgtggctgcggtctccagggcgggtcgggtccaggggcccccagcagtcgacaagtaacgagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacaagtaacgagcatatgctgagcgggctggcaaggc

SEQ ID NO: 2731 - DNA, 495 bp, Artificial Sequence
  Synthetic Template Oligonucleotide for IgH VJ Locus
gcctccctcgcgccatcagaagtaacgcatatgcttcagctcagccaaaaccctgcggctggtagggggcctgtggggctgggggctgatgtggctgcggtctccagggcgggtcgggtccaggggcccccagcagtcgacaagtaacgcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgaagtaacgcatatgctctgagcgggctggcaaggc

SEQ ID NO: 2732 - DNA, 495 bp, Artificial Sequence
  Synthetic Template Oligonucleotide for IgH VJ Locus
gcctccctcgcgccatcagaagtaacgtcgtcgattcagctcagccaaaaccctgcggctggtagggggcctgtggggctgggggctgatgtggctgcggtctccagggcgggtcgggtccaggggcccccagcagtcgacaagtaacgtcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccaagtaacgtcgtcgatctgagcgggctggcaaggc

SEQ ID NO: 2733 - DNA, 495 bp, Artificial Sequence
  Synthetic Template Oligonucleotide for IgH VJ Locus
gcctccctcgcgccatcagaagtaacgcagtctgttcagctcagccaaaaccctgcggctggtagggggcctgtggggctgggggctgatgtggctgcggtctccagggcgggtcgggtccaggggcccccagcagtcgacaagtaacgcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcaagtaacgcagtctgtctgagcgggctggcaaggc

SEQ ID NO: 2734 - DNA, 495 bp, Artificial Sequence
  Synthetic Template Oligonucleotide for IgH VJ Locus
gcctccctcgcgccatcagaagtaacgaacgcgtatcagctcagccaaaaccctgcggctggtagggggcctgtggggctgggggctgatgtggctgcggtctccagggcgggtcgggtccaggggcccccagcagtcgacaagtaacgaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgaagtaacgaacgcgtactgagcgggctggcaaggc

SEQ ID NO: 2735 - DNA, 495 bp, Artificial Sequence
  Synthetic Template Oligonucleotide for IgH VJ Locus
gcctccctcgcgccatcagaagtaacggtagttcgtcagctcagccaaaaccctgcggctggtagggggcctgtggggctgggggctgatgtggctgcggtctccagggcgggtcgggtccaggggcccccagcagtcgacaagtaacggtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcaagtaacggtagttcgctgagcgggctggcaaggc

SEQ ID NO: 2736 - DNA, 495 bp, Artificial Sequence
  Synthetic Template Oligonucleotide for IgH VJ Locus
gcctccctcgcgccatcagaagtaacgcgaactactcagctcagccaaaaccctgcggctggtagggggcctgtggggctgggggctgatgtggctgcggtctccagggcgggtcgggtccaggggcccccagcagtcgacaagtaacgcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacaagtaacgcgaactacctgagcgggctggcaaggc

SEQ ID NO: 2737 - DNA, 495 bp, Artificial Sequence
  Synthetic Template Oligonucleotide for IgH VJ Locus
gcctccctcgcgccatcagaagtaacgttaacgtctcagctcagccaaaaccctgcggctggtagggggcctgtggggctgggggctgatgtggctgcggtctccagggcgggtcgggtccaggggcccccagcagtcgacaagtaacgttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccaagtaacgttaacgtcctgagcgggctggcaaggc

SEQ ID NO: 2738 - DNA, 495 bp, Artificial Sequence
  Synthetic Template Oligonucleotide for IgH VJ Locus
gcctccctcgcgccatcagaagtaacgagcaaccttcagctcagccaaaaccctgcggctggtagggggcctgtggggctgggggctgatgtggctgcggtctccagggcgggtcgggtccaggggcccccagcagtcgacaagtaacgagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacaagtaacgagcaacctctgagcgggctggcaaggc

SEQ ID NO: 2739 - DNA, 495 bp, Artificial Sequence
  Synthetic Template Oligonucleotide for IgH VJ Locus
gcctccctcgcgccatcagaagtaacgttctcgagtcagctcagccaaaaccctgcggctggtagggggcctgtggggctgggggctgatgtggctgcggtctccagggcgggtcgggtccaggggcccccagcagtcgacaagtaacgttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttaagtaacgttctcgagctgagcgggctggcaaggc

SEQ ID NO: 2740 - DNA, 495 bp, Artificial Sequence
  Synthetic Template Oligonucleotide for IgH VJ Locus
gcctccctcgcgccatcagaagtaacgactctacgtcagctcagccaaaaccctgcggctggtagggggcctgtggggctgggggctgatgtggctgcggtctccagggcgggtcgggtccaggggcccccagcagtcgacaagtaacgactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacaagtaacgactctacgctgagcgggctggcaaggc

SEQ ID NO: 2741 - DNA, 495 bp, Artificial Sequence
  Synthetic Template Oligonucleotide for IgH VJ Locus
gcctccctcgcgccatcagaagtaacgtaccggaatcagctcagccaaaaccctgcggctggtagggggcctgtggggctgggggctgatgtggctgcggtctccagggcgggtcgggtccaggggcccccagcagtcgacaagtaacgtaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccaagtaacgtaccggaactgagcgggctggcaaggc

SEQ ID NO: 2742 - DNA, 495 bp, Artificial Sequence
  Synthetic Template Oligonucleotide for IgH VJ Locus
gcctccctcgcgccatcagaagtaacgcgaattgctcagctcagccaaaaccctgcggctggtagggggcctgtggggctgggggctgatgtggctgcggtctccagggcgggtcgggtccaggggcccccagcagtcgacaagtaacgcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacaagtaacgcgaattgcctgagcgggctggcaaggc

SEQ ID NO: 2743 - DNA, 495 bp, Artificial Sequence
  Synthetic Template Oligonucleotide for IgH VJ Locus
gcctccctcgcgccatcagaagtaacgttcgctcatcagctcagccaaaaccctgcggctggtagggggcctgtggggctgggggctgatgtggctgcggtctccagggcgggtcgggtccaggggcccccagcagtcgacaagtaacgttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacaaagtaacgttcgctcactgagcgggctggcaaggc

SEQ ID NO: 2744 - DNA, 495 bp, Artificial Sequence
  Synthetic Template Oligonucleotide for IgH VJ Locus
gcctccctcgcgccatcagaagtaacggacgttaatcagctcagccaaaaccctgcggctggtagggggcctgtggggctgggggctgatgtggctgcggtctccagggcgggtcgggtccaggggcccccagcagtcgacaagtaacggacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgaagtaacggacgttaactgagcgggctggcaaggc

SEQ ID NO: 2745 - DNA, 495 bp, Artificial Sequence
  Synthetic Template Oligonucleotide for IgH VJ Locus
gcctccctcgcgccatcagaagtaacgcgtagagttcagctcagccaaaaccctgcggctggtagggggcctgtggggctgggggctgatgtggctgcggtctccagggcgggtcgggtccaggggcccccagcagtcgacaagtaacgcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcaagtaacgcgtagagtctgagcgggctggcaaggc

SEQ ID NO: 2746 - DNA, 495 bp, Artificial Sequence
  Synthetic Template Oligonucleotide for IgH VJ Locus
gcctccctcgcgccatcagaagtaacgttccggtatcagctcagccaaaaccctgcggctggtagggggcctgtggggctgggggctgatgtggctgcggtctccagggcgggtcgggtccaggggcccccagcagtcgacaagtaacgttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcaagtaacgttccggtactgagcgggctggcaaggc

SEQ ID NO: 2747 - DNA, 495 bp, Artificial Sequence
  Synthetic Template Oligonucleotide for IgH VJ Locus
gcctccctcgcgccatcagaagtaacggcaattcgtcagctcagccaaaaccctgcggctggtagggggcctgtggggctgggggctgatgtggctgcggtctccagggcgggtcgggtccaggggcccccagcagtcgacaagtaacggcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacaagtaacggcaattcgctgagcgggctggcaaggc

SEQ ID NO: 2748 - DNA, 495 bp, Artificial Sequence
  Synthetic Template Oligonucleotide for IgH VJ Locus
gcctccctcgcgccatcagaagtaacgtgagcgaatcagctcagccaaaaccctgcggctggtagggggcctgtggggctgggggctgatgtggctgcggtctccagggcgggtcgggtccaggggcccccagcagtcgacaagtaacgtgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcaagtaacgtgagcgaactgagcgggctggcaaggc

SEQ ID NO: 2749 - DNA, 495 bp, Artificial Sequence
  Synthetic Template Oligonucleotide for IgH VJ Locus
gcctccctcgcgccatcagaagtaacgtactaagctcagctcagccaaaaccctgcggctggtagggggcctgtggggctgggggctgatgtggctgcggtctccagggcgggtcgggtccaggggcccccagcagtcgacaagtaacgtactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccaagtaacgtactaagcctgagcgggctggcaaggc

SEQ ID NO: 2750 - DNA, 495 bp, Artificial Sequence
  Synthetic Template Oligonucleotide for IgH VJ Locus
gcctccctcgcgccatcagaagtaacgtggcgtattcagctcagccaaaaccctgcggctggtagggggcctgtggggctgggggctgatgtggctgcggtctccagggcgggtcgggtccaggggcccccagcagtcgacaagtaacgtggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtaagtaacgtggcgtatctgagcgggctggcaaggc

SEQ ID NO: 2751 - DNA, 495 bp, Artificial Sequence
  Synthetic Template Oligonucleotide for IgH VJ Locus
gcctccctcgcgccatcagaagtaacggataaccatcagctcagccaaaaccctgcggctggtagggggcctgtggggctgggggctgatgtggctgcggtctccagggcgggtcgggtccaggggcccccagcagtcgacaagtaacggataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgaagtaacggataaccactgagcgggctggcaaggc

SEQ ID NO: 2752 - DNA, 495 bp, Artificial Sequence
  Synthetic Template Oligonucleotide for IgH VJ Locus
gcctccctcgcgccatcagaagtaacgctagtgaatcagctcagccaaaaccctgcggctggtagggggcctgtggggctgggggctgatgtggctgcggtctccagggcgggtcgggtccaggggcccccagcagtcgacaagtaacgctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagaagtaacgctagtgaactgagcgggctggcaaggc

SEQ ID NO: 2753 - DNA, 495 bp, Artificial Sequence
  Synthetic Template Oligonucleotide for IgH VJ Locus
gcctccctcgcgccatcagaagtaacgacgttcactcagctcagccaaaaccctgcggctggtagggggcctgtggggctgggggctgatgtggctgcggtctccagggcgggtcgggtccaggggcccccagcagtcgacaagtaacgacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtaagtaacgacgttcacctgagcgggctggcaaggc

SEQ ID NO: 2754 - DNA, 448 bp, Artificial Sequence
  Synthetic Template Oligonucleotide for IgH VJ Locus
gcctccctcgcgccatcagaagtaacgattacgcttcagctcagccaaaaccctgcggctggtagggggcctgtggggctgggggctgatgtggctgcggtctccagggcgggtcgggtccaggggcccccagcagtcgacaagtaacgattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcaaagtaacgattacgctctgagcgggctggcaaggc

SEQ ID NO: 2755 - DNA, 495 bp, Artificial Sequence
  Synthetic Template Oligonucleotide for IgH VJ Locus
gcctccctcgcgccatcagaagtaacgcattgagttcagctcagccaaaaccctgcggctggtagggggcctgtggggctgggggctgatgtggctgcggtctccagggcgggtcgggtccaggggcccccagcagtcgacaagtaacgcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccaagtaacgcattgagtctgagcgggctggcaaggc

SEQ ID NO: 2756 - DNA, 495 bp, Artificial Sequence
  Synthetic Template Oligonucleotide for IgH VJ Locus
gcctccctcgcgccatcaggtctcctacttggttaccagccacacagacccccgggctgagacccaggcagggaggggtgacgttcccagggagacggtggccgggctgccctggccccagtgctccaagcacttgtcgacgtctcctacttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgtctcctacttggttactgagcgggctggcaaggc

SEQ ID NO: 2757 - DNA, 495 bp, Artificial Sequence
  Synthetic Template Oligonucleotide for IgH VJ Locus
gcctccctcgcgccatcaggtctcctaacctcttgccagccacacagacccccgggctgagacccaggcagggaggggtgacgttcccagggagacggtggccgggctgccctggccccagtgctccaagcacttgtcgacgtctcctaacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgtctcctaacctcttgctgagcgggctggcaaggc

SEQ ID NO: 2758 - DNA, 495 bp, Artificial Sequence
  Synthetic Template Oligonucleotide for IgH VJ Locus
gcctccctcgcgccatcaggtctcctactgattctccagccacacagacccccgggctgagacccaggcagggaggggtgacgttcccagggagacggtggccgggctgccctggccccagtgctccaagcacttgtcgacgtctcctactgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgtctcctactgattctctgagcgggctggcaaggc

SEQ ID NO: 2759 - DNA, 495 bp, Artificial Sequence
  Synthetic Template Oligonucleotide for IgH VJ Locus
gcctccctcgcgccatcaggtctcctaagtaccgaccagccacacagacccccgggctgagacccaggcagggaggggtgacgttcccagggagacggtggccgggctgccctggccccagtgctccaagcacttgtcgacgtctcctaagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgtctcctaagtaccgactgagcgggctggcaaggc

SEQ ID NO: 2760 - DNA, 495 bp, Artificial Sequence
  Synthetic Template Oligonucleotide for IgH VJ Locus
gcctccctcgcgccatcaggtctcctaatccatggccagccacacagacccccgggctgagacccaggcagggaggggtgacgttcccagggagacggtggccgggctgccctggccccagtgctccaagcacttgtcgacgtctcctaatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgtctcctaatccatggctgagcgggctggcaaggc

SEQ ID NO: 2761 - DNA, 495 bp, Artificial Sequence
  Synthetic Template Oligonucleotide for IgH VJ Locus
gcctccctcgcgccatcaggtctcctagtagcagtccagccacacagacccccgggctgagacccaggcagggaggggtgacgttcccagggagacggtggccgggctgccctggccccagtgctccaagcacttgtcgacgtctcctagtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgtctcctagtagcagtctgagcgggctggcaaggc

SEQ ID NO: 2762 - DNA, 495 bp, Artificial Sequence
  Synthetic Template Oligonucleotide for IgH VJ Locus
gcctccctcgcgccatcaggtctcctaatcttcgtccagccacacagacccccgggctgagacccaggcagggaggggtgacgttcccagggagacggtggccgggctgccctggccccagtgctccaagcacttgtcgacgtctcctaatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgtctcctaatcttcgtctgagcgggctggcaaggc

SEQ ID NO: 2763 - DNA, 495 bp, Artificial Sequence
  Synthetic Template Oligonucleotide for IgH VJ Locus
gcctccctcgcgccatcaggtctcctatccacagtccagccacacagacccccgggctgagacccaggcagggaggggtgacgttcccagggagacggtggccgggctgccctggccccagtgctccaagcacttgtcgacgtctcctatccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgtctcctatccacagtctgagcgggctggcaaggc

SEQ ID NO: 2764 - DNA, 495 bp, Artificial Sequence
  Synthetic Template Oligonucleotide for IgH VJ Locus
gcctccctcgcgccatcaggtctcctaagctagtgccagccacacagacccccgggctgagacccaggcagggaggggtgacgttcccagggagacggtggccgggctgccctggccccagtgctccaagcacttgtcgacgtctcctaagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgtctcctaagctagtgctgagcgggctggcaaggc

SEQ ID NO: 2765 - DNA, 495 bp, Artificial Sequence
  Synthetic Template Oligonucleotide for IgH VJ Locus
gcctccctcgcgccatcaggtctcctataaccaagccagccacacagacccccgggctgagacccaggcagggaggggtgacgttcccagggagacggtggccgggctgccctggccccagtgctccaagcacttgtcgacgtctcctataaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgtctcctataaccaagctgagcgggctggcaaggc

SEQ ID NO: 2766 - DNA, 495 bp, Artificial Sequence
  Synthetic Template Oligonucleotide for IgH VJ Locus
gcctccctcgcgccatcaggtctcctacaagaggtccagccacacagacccccgggctgagacccaggcagggaggggtgacgttcccagggagacggtggccgggctgccctggccccagtgctccaagcacttgtcgacgtctcctacaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgtctcctacaagaggtctgagcgggctggcaaggc

SEQ ID NO: 2767 - DNA, 495 bp, Artificial Sequence
  Synthetic Template Oligonucleotide for IgH VJ Locus
gcctccctcgcgccatcaggtctcctaagttgaccccagccacacagacccccgggctgagacccaggcagggaggggtgacgttcccagggagacggtggccgggctgccctggccccagtgctccaagcacttgtcgacgtctcctaagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagtctcctaagttgaccctgagcgggctggcaaggc

SEQ ID NO: 2768 - DNA, 495 bp, Artificial Sequence
  Synthetic Template Oligonucleotide for IgH VJ Locus
gcctccctcgcgccatcaggtctcctacagcatatccagccacacagacccccgggctgagacccaggcagggaggggtgacgttcccagggagacggtggccgggctgccctggccccagtgctccaagcacttgtcgacgtctcctacagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagtctcctacagcatatctgagcgggctggcaaggc

SEQ ID NO: 2769 - DNA, 495 bp, Artificial Sequence
  Synthetic Template Oligonucleotide for IgH VJ Locus
gcctccctcgcgccatcaggtctcctagcaggattccagccacacagacccccgggctgagacccaggcagggaggggtgacgttcccagggagacggtggccgggctgccctggccccagtgctccaagcacttgtcgacgtctcctagcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagtctcctagcaggattctgagcgggctggcaaggc

SEQ ID NO: 2770 - DNA, 495 bp, Artificial Sequence
  Synthetic Template Oligonucleotide for IgH VJ Locus
gcctccctcgcgccatcaggtctcctagtccattcccagccacacagacccccgggctgagacccaggcagggaggggtgacgttcccagggagacggtggccgggctgccctggccccagtgctccaagcacttgtcgacgtctcctagtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgtctcctagtccattcctgagcgggctggcaaggc

SEQ ID NO: 2771 - DNA, 495 bp, Artificial Sequence
  Synthetic Template Oligonucleotide for IgH VJ Locus
gcctccctcgcgccatcaggtctcctagcataactccagccacacagacccccgggctgagacccaggcagggaggggtgacgttcccagggagacggtggccgggctgccctggccccagtgctccaagcacttgtcgacgtctcctagcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgtctcctagcataactctgagcgggctggcaaggc

SEQ ID NO: 2772 - DNA, 495 bp, Artificial Sequence
  Synthetic Template Oligonucleotide for IgH VJ Locus
gcctccctcgcgccatcaggtctcctaatatgctgccagccacacagacccccgggctgagacccaggcagggaggggtgacgttcccagggagacggtggccgggctgccctggccccagtgctccaagcacttgtcgacgtctcctaatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgtctcctaatatgctgctgagcgggctggcaaggc

SEQ ID NO: 2773 - DNA, 495 bp, Artificial Sequence
  Synthetic Template Oligonucleotide for IgH VJ Locus
gcctccctcgcgccatcaggtctcctaaatcctgcccagccacacagacccccgggctgagacccaggcagggaggggtgacgttcccagggagacggtggccgggctgccctggccccagtgctccaagcacttgtcgacgtctcctaaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgtctcctaaatcctgcctgagcgggctggcaaggc

SEQ ID NO: 2774 - DNA, 495 bp, Artificial Sequence
  Synthetic Template Oligonucleotide for IgH VJ Locus
gcctccctcgcgccatcaggtctcctatgagacctccagccacacagacccccgggctgagacccaggcagggaggggtgacgttcccagggagacggtggccgggctgccctggccccagtgctccaagcacttgtcgacgtctcctatgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggtctcctatgagacctctgagcgggctggcaaggc

SEQ ID NO: 2775 - DNA, 495 bp, Artificial Sequence
  Synthetic Template Oligonucleotide for IgH VJ Locus
gcctccctcgcgccatcaggtctcctagaatggacccagccacacagacccccgggctgagacccaggcagggaggggtgacgttcccagggagacggtggccgggctgccctggccccagtgctccaagcacttgtcgacgtctcctagaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgtctcctagaatggacctgagcgggctggcaaggc

SEQ ID NO: 2776 - DNA, 495 bp, Artificial Sequence
  Synthetic Template Oligonucleotide for IgH VJ Locus
gcctccctcgcgccatcaggtctcctacacatggaccagccacacagacccccgggctgagacccaggcagggaggggtgacgttcccagggagacggtggccgggctgccctggccccagtgctccaagcacttgtcgacgtctcctacacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgtctcctacacatggactgagcgggctggcaaggc

SEQ ID NO: 2777 - DNA, 495 bp, Artificial Sequence
  Synthetic Template Oligonucleotide for IgH VJ Locus
gcctccctcgcgccatcaggtctcctattgaccatccagccacacagacccccgggctgagacccaggcagggaggggtgacgttcccagggagacggtggccgggctgccctggccccagtgctccaagcacttgtcgacgtctcctattgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgtctcctattgaccatctgagcgggctggcaaggc

SEQ ID NO: 2778 - DNA, 495 bp, Artificial Sequence
  Synthetic Template Oligonucleotide for IgH VJ Locus
gcctccctcgcgccatcaggtctcctaaagccatcccagccacacagacccccgggctgagacccaggcagggaggggtgacgttcccagggagacggtggccgggctgccctggccccagtgctccaagcacttgtcgacgtctcctaaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgtctcctaaagccatcctgagcgggctggcaaggc

SEQ ID NO: 2779 - DNA, 495 bp, Artificial Sequence
  Synthetic Template Oligonucleotide for IgH VJ Locus
gcctccctcgcgccatcaggtctcctatccatgtgccagccacacagacccccgggctgagacccaggcagggaggggtgacgttcccagggagacggtggccgggctgccctggccccagtgctccaagcacttgtcgacgtctcctatccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtctcctatccatgtgctgagcgggctggcaaggc

SEQ ID NO: 2780 - DNA, 495 bp, Artificial Sequence
  Synthetic Template Oligonucleotide for IgH VJ Locus
gcctccctcgcgccatcaggtctcctacaagtcacccagccacacagacccccgggctgagacccaggcagggaggggtgacgttcccagggagacggtggccgggctgccctggccccagtgctccaagcacttgtcgacgtctcctacaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtctcctacaagtcacctgagcgggctggcaaggc

SEQ ID NO: 2781 - DNA, 495 bp, Artificial Sequence
  Synthetic Template Oligonucleotide for IgH VJ Locus
gcctccctcgcgccatcaggtctcctactgcaatcccagccacacagacccccgggctgagacccaggcagggaggggtgacgttcccagggagacggtggccgggctgccctggccccagtgctccaagcacttgtcgacgtctcctactgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgtctcctactgcaatcctgagcgggctggcaaggc

SEQ ID NO: 2782 - DNA, 495 bp, Artificial Sequence
  Synthetic Template Oligonucleotide for IgH VJ Locus
gcctccctcgcgccatcaggtctcctaatcgacgaccagccacacagacccccgggctgagacccaggcagggaggggtgacgttcccagggagacggtggccgggctgccctggccccagtgctccaagcacttgtcgacgtctcctaatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgtctcctaatcgacgactgagcgggctggcaaggc

SEQ ID NO: 2783 - DNA, 495 bp, Artificial Sequence
  Synthetic Template Oligonucleotide for IgH VJ Locus
gcctccctcgcgccatcaggtctcctaacagactgccagccacacagacccccgggctgagacccaggcagggaggggtgacgttcccagggagacggtggccgggctgccctggccccagtgctccaagcacttgtcgacgtctcctaacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagtctcctaacagactgctgagcgggctggcaaggc

SEQ ID NO: 2784 - DNA, 495 bp, Artificial Sequence
  Synthetic Template Oligonucleotide for IgH VJ Locus
gcctccctcgcgccatcaggtctcctaccttatagccagccacacagacccccgggctgagacccaggcagggaggggtgacgttcccagggagacggtggccgggctgccctggccccagtgctccaagcacttgtcgacgtctcctaccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgtctcctaccttatagctgagcgggctggcaaggc

SEQ ID NO: 2785 - DNA, 495 bp, Artificial Sequence
  Synthetic Template Oligonucleotide for IgH VJ Locus
gcctccctcgcgccatcaggtctcctatacgcgttccagccacacagacccccgggctgagacccaggcagggaggggtgacgttcccagggagacggtggccgggctgccctggccccagtgctccaagcacttgtcgacgtctcctatacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgtctcctatacgcgttctgagcgggctggcaaggc

SEQ ID NO: 2786 - DNA, 495 bp, Artificial Sequence
  Synthetic Template Oligonucleotide for IgH VJ Locus
gcctccctcgcgccatcaggtctcctactataaggccagccacacagacccccgggctgagacccaggcagggaggggtgacgttcccagggagacggtggccgggctgccctggccccagtgctccaagcacttgtcgacgtctcctactataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggtctcctactataaggctgagcgggctggcaaggc

SEQ ID NO: 2787 - DNA, 495 bp, Artificial Sequence
  Synthetic Template Oligonucleotide for IgH VJ Locus
gcctccctcgcgccatcaggtctcctatcttagtcccagccacacagacccccgggctgagacccaggcagggaggggtgacgttcccagggagacggtggccgggctgccctggccccagtgctccaagcacttgtcgacgtctcctatcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtctcctatcttagtcctgagcgggctggcaaggc

SEQ ID NO: 2788 - DNA, 495 bp, Artificial Sequence
  Synthetic Template Oligonucleotide for IgH VJ Locus
gcctccctcgcgccatcaggtctcctatgtctgcaccagccacacagacccccgggctgagacccaggcagggaggggtgacgttcccagggagacggtggccgggctgccctggccccagtgctccaagcacttgtcgacgtctcctatgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgtctcctatgtctgcactgagcgggctggcaaggc

SEQ ID NO: 2789 - DNA, 495 bp, Artificial Sequence
  Synthetic Template Oligonucleotide for IgH VJ Locus
gcctccctcgcgccatcaggtctcctagccattaaccagccacacagacccccgggctgagacccaggcagggaggggtgacgttcccagggagacggtggccgggctgccctggccccagtgctccaagcacttgtcgacgtctcctagccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtctcctagccattaactgagcgggctggcaaggc

SEQ ID NO: 2790 - DNA, 495 bp, Artificial Sequence
  Synthetic Template Oligonucleotide for IgH VJ Locus
gcctccctcgcgccatcaggtctcctagactaagaccagccacacagacccccgggctgagacccaggcagggaggggtgacgttcccagggagacggtggccgggctgccctggccccagtgctccaagcacttgtcgacgtctcctagactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggtctcctagactaagactgagcgggctggcaaggc

SEQ ID NO: 2791 - DNA, 495 bp, Artificial Sequence
  Synthetic Template Oligonucleotide for IgH VJ Locus
gcctccctcgcgccatcaggtctcctaaggttgctccagccacacagacccccgggctgagacccaggcagggaggggtgacgttcccagggagacggtggccgggctgccctggccccagtgctccaagcacttgtcgacgtctcctaaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggtctcctaaggttgctctgagcgggctggcaaggc

SEQ ID NO: 2792 - DNA, 495 bp, Artificial Sequence
  Synthetic Template Oligonucleotide for IgH VJ Locus
gcctccctcgcgccatcaggtctcctactcgagaaccagccacacagacccccgggctgagacccaggcagggaggggtgacgttcccagggagacggtggccgggctgccctggccccagtgctccaagcacttgtcgacgtctcctactcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgtctcctactcgagaactgagcgggctggcaaggc

SEQ ID NO: 2793 - DNA, 495 bp, Artificial Sequence
  Synthetic Template Oligonucleotide for IgH VJ Locus
gcctccctcgcgccatcaggtctcctattaatggcccagccacacagacccccgggctgagacccaggcagggaggggtgacgttcccagggagacggtggccgggctgccctggccccagtgctccaagcacttgtcgacgtctcctattaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgtctcctattaatggcctgagcgggctggcaaggc

SEQ ID NO: 2794 - DNA, 495 bp, Artificial Sequence
  Synthetic Template Oligonucleotide for IgH VJ Locus
gcctccctcgcgccatcaggtctcctatgcagacaccagccacacagacccccgggctgagacccaggcagggaggggtgacgttcccagggagacggtggccgggctgccctggccccagtgctccaagcacttgtcgacgtctcctatgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagtctcctatgcagacactgagcgggctggcaaggc

SEQ ID NO: 2795 - DNA, 495 bp, Artificial Sequence
  Synthetic Template Oligonucleotide for IgH VJ Locus
gcctccctcgcgccatcaggtctcctatcactgagccagccacacagacccccgggctgagacccaggcagggaggggtgacgttcccagggagacggtggccgggctgccctggccccagtgctccaagcacttgtcgacgtctcctatcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgtctcctatcactgagctgagcgggctggcaaggc

SEQ ID NO: 2796 - DNA, 495 bp, Artificial Sequence
  Synthetic Template Oligonucleotide for IgH VJ Locus
gcctccctcgcgccatcaggtctcctagagtacgtccagccacacagacccccgggctgagacccaggcagggaggggtgacgttcccagggagacggtggccgggctgccctggccccagtgctccaagcacttgtcgacgtctcctagagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgtctcctagagtacgtctgagcgggctggcaaggc

SEQ ID NO: 2797 - DNA, 495 bp, Artificial Sequence
  Synthetic Template Oligonucleotide for IgH VJ Locus
gcctccctcgcgccatcaggtctcctaatacgccaccagccacacagacccccgggctgagacccaggcagggaggggtgacgttcccagggagacggtggccgggctgccctggccccagtgctccaagcacttgtcgacgtctcctaatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgtctcctaatacgccactgagcgggctggcaaggc

SEQ ID NO: 2798 - DNA, 495 bp, Artificial Sequence
  Synthetic Template Oligonucleotide for IgH VJ Locus
gcctccctcgcgccatcaggtctcctatcgcatcaccagccacacagacccccgggctgagacccaggcagggaggggtgacgttcccagggagacggtggccgggctgccctggccccagtgctccaagcacttgtcgacgtctcctatcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgtctcctatcgcatcactgagcgggctggcaaggc

SEQ ID NO: 2799 - DNA, 495 bp, Artificial Sequence
  Synthetic Template Oligonucleotide for IgH VJ Locus
gcctccctcgcgccatcaggtctcctacgcttaatccagccacacagacccccgggctgagacccaggcagggaggggtgacgttcccagggagacggtggccgggctgccctggccccagtgctccaagcacttgtcgacgtctcctacgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgtctcctacgcttaatctgagcgggctggcaaggc

SEQ ID NO: 2800 - DNA, 495 bp, Artificial Sequence
  Synthetic Template Oligonucleotide for IgH VJ Locus
gcctccctcgcgccatcaggtctcctatggttatcccagccacacagacccccgggctgagacccaggcagggaggggtgacgttcccagggagacggtggccgggctgccctggccccagtgctccaagcacttgtcgacgtctcctatggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgtctcctatggttatcctgagcgggctggcaaggc

SEQ ID NO: 2801 - DNA, 495 bp, Artificial Sequence
  Synthetic Template Oligonucleotide for IgH VJ Locus
gcctccctcgcgccatcaggtctcctaggattgctccagccacacagacccccgggctgagacccaggcagggaggggtgacgttcccagggagacggtggccgggctgccctggccccagtgctccaagcacttgtcgacgtctcctaggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgtctcctaggattgctctgagcgggctggcaaggc

SEQ ID NO: 2802 - DNA, 495 bp, Artificial Sequence
  Synthetic Template Oligonucleotide for IgH VJ Locus
gcctccctcgcgccatcaggtctcctactcagtgaccagccacacagacccccgggctgagacccaggcagggaggggtgacgttcccagggagacggtggccgggctgccctggccccagtgctccaagcacttgtcgacgtctcctactcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgtctcctactcagtgactgagcgggctggcaaggc

SEQ ID NO: 2803 - DNA, 495 bp, Artificial Sequence
  Synthetic Template Oligonucleotide for IgH VJ Locus
gcctccctcgcgccatcaggtctcctaacgtactcccagccacacagacccccgggctgagacccaggcagggaggggtgacgttcccagggagacggtggccgggctgccctggccccagtgctccaagcacttgtcgacgtctcctaacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgtctcctaacgtactcctgagcgggctggcaaggc

SEQ ID NO: 2804 - DNA, 495 bp, Artificial Sequence
  Synthetic Template Oligonucleotide for IgH VJ Locus
gcctccctcgcgccatcaggtctcctatgatgcgaccagccacacagacccccgggctgagacccaggcagggaggggtgacgttcccagggagacggtggccgggctgccctggccccagtgctccaagcacttgtcgacgtctcctatgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgtctcctatgatgcgactgagcgggctggcaaggc

SEQ ID NO: 2805 - DNA, 495 bp, Artificial Sequence
  Synthetic Template Oligonucleotide for IgH VJ Locus
gcctccctcgcgccatcaggtctcctaattaagcgccagccacacagacccccgggctgagacccaggcagggaggggtgacgttcccagggagacggtggccgggctgccctggccccagtgctccaagcacttgtcgacgtctcctaattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgtctcctaattaagcgctgagcgggctggcaaggc

SEQ ID NO: 2806 - DNA, 495 bp, Artificial Sequence
  Synthetic Template Oligonucleotide for IgH VJ Locus
gcctccctcgcgccatcaggtctcctaagcaatccccagccacacagacccccgggctgagacccaggcagggaggggtgacgttcccagggagacggtggccgggctgccctggccccagtgctccaagcacttgtcgacgtctcctaagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgtctcctaagcaatccctgagcgggctggcaaggc

SEQ ID NO: 2807 - DNA, 495 bp, Artificial Sequence
  Synthetic Template Oligonucleotide for IgH VJ Locus
gcctccctcgcgccatcaggtctcctagcttagtaccagccacacagacccccgggctgagacccaggcagggaggggtgacgttcccagggagacggtggccgggctgccctggccccagtgctccaagcacttgtcgacgtctcctagcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagtctcctagcttagtactgagcgggctggcaaggc

SEQ ID NO: 2808 - DNA, 495 bp, Artificial Sequence
  Synthetic Template Oligonucleotide for IgH VJ Locus
gcctccctcgcgccatcaggtctcctatgaccttgccagccacacagacccccgggctgagacccaggcagggaggggtgacgttcccagggagacggtggccgggctgccctggccccagtgctccaagcacttgtcgacgtctcctatgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgtctcctatgaccttgctgagcgggctggcaaggc

SEQ ID NO: 2809 - DNA, 495 bp, Artificial Sequence
  Synthetic Template Oligonucleotide for IgH VJ Locus
gcctccctcgcgccatcaggtctcctacaaggtcaccagccacacagacccccgggctgagacccaggcagggaggggtgacgttcccagggagacggtggccgggctgccctggccccagtgctccaagcacttgtcgacgtctcctacaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgtctcctacaaggtcactgagcgggctggcaaggc

SEQ ID NO: 2810 - DNA, 495 bp, Artificial Sequence
  Synthetic Template Oligonucleotide for IgH VJ Locus
gcctccctcgcgccatcaggtctcctacactgtacccagccacacagacccccgggctgagacccaggcagggaggggtgacgttcccagggagacggtggccgggctgccctggccccagtgctccaagcacttgtcgacgtctcctacactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgtctcctacactgtacctgagcgggctggcaaggc

SEQ ID NO: 2811 - DNA, 495 bp, Artificial Sequence
  Synthetic Template Oligonucleotide for IgH VJ Locus
gcctccctcgcgccatcaggtctcctagatgatccccagccacacagacccccgggctgagacccaggcagggaggggtgacgttcccagggagacggtggccgggctgccctggccccagtgctccaagcacttgtcgacgtctcctagatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggtctcctagatgatccctgagcgggctggcaaggc

SEQ ID NO: 2812 - DNA, 495 bp, Artificial Sequence
  Synthetic Template Oligonucleotide for IgH VJ Locus
gcctccctcgcgccatcaggtctcctacgccaataccagccacacagacccccgggctgagacccaggcagggaggggtgacgttcccagggagacggtggccgggctgccctggccccagtgctccaagcacttgtcgacgtctcctacgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggtctcctacgccaatactgagcgggctggcaaggc

SEQ ID NO: 2813 - DNA, 495 bp, Artificial Sequence
  Synthetic Template Oligonucleotide for IgH VJ Locus
gcctccctcgcgccatcaggtctcctatcaagcctccagccacacagacccccgggctgagacccaggcagggaggggtgacgttcccagggagacggtggccgggctgccctggccccagtgctccaagcacttgtcgacgtctcctatcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagtctcctatcaagcctctgagcgggctggcaaggc

SEQ ID NO: 2814 - DNA, 495 bp, Artificial Sequence
  Synthetic Template Oligonucleotide for IgH VJ Locus
gcctccctcgcgccatcaggtctcctaacgtgtgtccagccacacagacccccgggctgagacccaggcagggaggggtgacgttcccagggagacggtggccgggctgccctggccccagtgctccaagcacttgtcgacgtctcctaacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggtctcctaacgtgtgtctgagcgggctggcaaggc

SEQ ID NO: 2815 - DNA, 495 bp, Artificial Sequence
  Synthetic Template Oligonucleotide for IgH VJ Locus
gcctccctcgcgccatcaggtctcctatccgtctaccagccacacagacccccgggctgagacccaggcagggaggggtgacgttcccagggagacggtggccgggctgccctggccccagtgctccaagcacttgtcgacgtctcctatccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggtctcctatccgtctactgagcgggctggcaaggc

SEQ ID NO: 2816 - DNA, 495 bp, Artificial Sequence
  Synthetic Template Oligonucleotide for IgH VJ Locus
gcctccctcgcgccatcaggtctcctaaagagctgccagccacacagacccccgggctgagacccaggcagggaggggtgacgttcccagggagacggtggccgggctgccctggccccagtgctccaagcacttgtcgacgtctcctaaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggtctcctaaagagctgctgagcgggctggcaaggc

SEQ ID NO: 2817 - DNA, 495 bp, Artificial Sequence
  Synthetic Template Oligonucleotide for IgH VJ Locus
gcctccctcgcgccatcaggtctcctatatcgctcccagccacacagacccccgggctgagacccaggcagggaggggtgacgttcccagggagacggtggccgggctgccctggccccagtgctccaagcacttgtcgacgtctcctatatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggtctcctatatcgctcctgagcgggctggcaaggc

SEQ ID NO: 2818 - DNA, 495 bp, Artificial Sequence
  Synthetic Template Oligonucleotide for IgH VJ Locus
gcctccctcgcgccatcaggtctcctatcagatgcccagccacacagacccccgggctgagacccaggcagggaggggtgacgttcccagggagacggtggccgggctgccctggccccagtgctccaagcacttgtcgacgtctcctatcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgtctcctatcagatgcctgagcgggctggcaaggc

SEQ ID NO: 2819 - DNA, 495 bp, Artificial Sequence
  Synthetic Template Oligonucleotide for IgH VJ Locus
gcctccctcgcgccatcaggtctcctagtgtagcaccagccacacagacccccgggctgagacccaggcagggaggggtgacgttcccagggagacggtggccgggctgccctggccccagtgctccaagcacttgtcgacgtctcctagtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggtctcctagtgtagcactgagcgggctggcaaggc

SEQ ID NO: 2820 - DNA, 495 bp, Artificial Sequence
  Synthetic Template Oligonucleotide for IgH VJ Locus
gcctccctcgcgccatcaggtctcctatggcagttccagccacacagacccccgggctgagacccaggcagggaggggtgacgttcccagggagacggtggccgggctgccctggccccagtgctccaagcacttgtcgacgtctcctatggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggtctcctatggcagttctgagcgggctggcaaggc

SEQ ID NO: 2821 - DNA, 495 bp, Artificial Sequence
  Synthetic Template Oligonucleotide for IgH VJ Locus
gcctccctcgcgccatcaggtctcctacagtccaaccagccacacagacccccgggctgagacccaggcagggaggggtgacgttcccagggagacggtggccgggctgccctggccccagtgctccaagcacttgtcgacgtctcctacagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgtctcctacagtccaactgagcgggctggcaaggc

SEQ ID NO: 2822 - DNA, 495 bp, Artificial Sequence
  Synthetic Template Oligonucleotide for IgH VJ Locus
gcctccctcgcgccatcaggtctcctagtgtctacccagccacacagacccccgggctgagacccaggcagggaggggtgacgttcccagggagacggtggccgggctgccctggccccagtgctccaagcacttgtcgacgtctcctagtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggtctcctagtgtctacctgagcgggctggcaaggc

SEQ ID NO: 2823 - DNA, 495 bp, Artificial Sequence
  Synthetic Template Oligonucleotide for IgH VJ Locus
gcctccctcgcgccatcaggtctcctagtacagtgccagccacacagacccccgggctgagacccaggcagggaggggtgacgttcccagggagacggtggccgggctgccctggccccagtgctccaagcacttgtcgacgtctcctagtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggtctcctagtacagtgctgagcgggctggcaaggc

SEQ ID NO: 2824 - DNA, 495 bp, Artificial Sequence
  Synthetic Template Oligonucleotide for IgH VJ Locus
gcctccctcgcgccatcaggtctcctaggatcatcccagccacacagacccccgggctgagacccaggcagggaggggtgacgttcccagggagacggtggccgggctgccctggccccagtgctccaagcacttgtcgacgtctcctaggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggtctcctaggatcatcctgagcgggctggcaaggc

SEQ ID NO: 2825 - DNA, 495 bp, Artificial Sequence
  Synthetic Template Oligonucleotide for IgH VJ Locus
gcctccctcgcgccatcaggtctcctatattggcgccagccacacagacccccgggctgagacccaggcagggaggggtgacgttcccagggagacggtggccgggctgccctggccccagtgctccaagcacttgtcgacgtctcctatattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagtctcctatattggcgctgagcgggctggcaaggc

SEQ ID NO: 2826 - DNA, 495 bp, Artificial Sequence
  Synthetic Template Oligonucleotide for IgH VJ Locus
gcctccctcgcgccatcaggtctcctaaggcttgaccagccacacagacccccgggctgagacccaggcagggaggggtgacgttcccagggagacggtggccgggctgccctggccccagtgctccaagcacttgtcgacgtctcctaaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgtctcctaaggcttgactgagcgggctggcaaggc

SEQ ID NO: 2827 - DNA, 495 bp, Artificial Sequence
  Synthetic Template Oligonucleotide for IgH VJ Locus
gcctccctcgcgccatcaggtctcctaacacacgtccagccacacagacccccgggctgagacccaggcagggaggggtgacgttcccagggagacggtggccgggctgccctggccccagtgctccaagcacttgtcgacgtctcctaacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgtctcctaacacacgtctgagcgggctggcaaggc

SEQ ID NO: 2828 - DNA, 495 bp, Artificial Sequence
  Synthetic Template Oligonucleotide for IgH VJ Locus
gcctccctcgcgccatcaggtctcctatagacggaccagccacacagacccccgggctgagacccaggcagggaggggtgacgttcccagggagacggtggccgggctgccctggccccagtgctccaagcacttgtcgacgtctcctatagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagtctcctatagacggactgagcgggctggcaaggc

SEQ ID NO: 2829 - DNA, 495 bp, Artificial Sequence
  Synthetic Template Oligonucleotide for IgH VJ Locus
gcctccctcgcgccatcaggtctcctagagcgataccagccacacagacccccgggctgagacccaggcagggaggggtgacgttcccagggagacggtggccgggctgccctggccccagtgctccaagcacttgtcgacgtctcctagagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgtctcctagagcgatactgagcgggctggcaaggc

SEQ ID NO: 2830 - DNA, 495 bp, Artificial Sequence
  Synthetic Template Oligonucleotide for IgH VJ Locus
gcctccctcgcgccatcaggtctcctagcatctgaccagccacacagacccccgggctgagacccaggcagggaggggtgacgttcccagggagacggtggccgggctgccctggccccagtgctccaagcacttgtcgacgtctcctagcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagtctcctagcatctgactgagcgggctggcaaggc

SEQ ID NO: 2831 - DNA, 495 bp, Artificial Sequence
  Synthetic Template Oligonucleotide for IgH VJ Locus
gcctccctcgcgccatcaggtctcctatgctacacccagccacacagacccccgggctgagacccaggcagggaggggtgacgttcccagggagacggtggccgggctgccctggccccagtgctccaagcacttgtcgacgtctcctatgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggtctcctatgctacacctgagcgggctggcaaggc

SEQ ID NO: 2832 - DNA, 495 bp, Artificial Sequence
  Synthetic Template Oligonucleotide for IgH VJ Locus
gcctccctcgcgccatcaggtctcctaaactgccaccagccacacagacccccgggctgagacccaggcagggaggggtgacgttcccagggagacggtggccgggctgccctggccccagtgctccaagcacttgtcgacgtctcctaaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgtctcctaaactgccactgagcgggctggcaaggc

SEQ ID NO: 2833 - DNA, 495 bp, Artificial Sequence
  Synthetic Template Oligonucleotide for IgH VJ Locus
gcctccctcgcgccatcaggtctcctattggactgccagccacacagacccccgggctgagacccaggcagggaggggtgacgttcccagggagacggtggccgggctgccctggccccagtgctccaagcacttgtcgacgtctcctattggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggtctcctattggactgctgagcgggctggcaaggc

SEQ ID NO: 2834 - DNA, 495 bp, Artificial Sequence
  Synthetic Template Oligonucleotide for IgH VJ Locus
gcctccctcgcgccatcaggtctcctatcggtactccagccacacagacccccgggctgagacccaggcagggaggggtgacgttcccagggagacggtggccgggctgccctggccccagtgctccaagcacttgtcgacgtctcctatcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggtctcctatcggtactctgagcgggctggcaaggc

SEQ ID NO: 2835 - DNA, 495 bp, Artificial Sequence
  Synthetic Template Oligonucleotide for IgH VJ Locus
gcctccctcgcgccatcaggtctcctaccatggatccagccacacagacccccgggctgagacccaggcagggaggggtgacgttcccagggagacggtggccgggctgccctggccccagtgctccaagcacttgtcgacgtctcctaccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgtctcctaccatggatctgagcgggctggcaaggc

SEQ ID NO: 2836 - DNA, 495 bp, Artificial Sequence
  Synthetic Template Oligonucleotide for IgH VJ Locus
gcctccctcgcgccatcaggtctcctaacgaagatccagccacacagacccccgggctgagacccaggcagggaggggtgacgttcccagggagacggtggccgggctgccctggccccagtgctccaagcacttgtcgacgtctcctaacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagtctcctaacgaagatctgagcgggctggcaaggc

SEQ ID NO: 2837 - DNA, 495 bp, Artificial Sequence
  Synthetic Template Oligonucleotide for IgH VJ Locus
gcctccctcgcgccatcaggtctcctaactgtggaccagccacacagacccccgggctgagacccaggcagggaggggtgacgttcccagggagacggtggccgggctgccctggccccagtgctccaagcacttgtcgacgtctcctaactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgtctcctaactgtggactgagcgggctggcaaggc

SEQ ID NO: 2838 - DNA, 495 bp, Artificial Sequence
  Synthetic Template Oligonucleotide for IgH VJ Locus
gcctccctcgcgccatcaggtctcctaggtgtcatccagccacacagacccccgggctgagacccaggcagggaggggtgacgttcccagggagacggtggccgggctgccctggccccagtgctccaagcacttgtcgacgtctcctaggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgtctcctaggtgtcatctgagcgggctggcaaggc

SEQ ID NO: 2839 - DNA, 495 bp, Artificial Sequence
  Synthetic Template Oligonucleotide for IgH VJ Locus
gcctccctcgcgccatcaggtctcctatcgtgaagccagccacacagacccccgggctgagacccaggcagggaggggtgacgttcccagggagacggtggccgggctgccctggccccagtgctccaagcacttgtcgacgtctcctatcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggtctcctatcgtgaagctgagcgggctggcaaggc

SEQ ID NO: 2840 - DNA, 495 bp, Artificial Sequence
  Synthetic Template Oligonucleotide for IgH VJ Locus
gcctccctcgcgccatcaggtctcctacactagctccagccacacagacccccgggctgagacccaggcagggaggggtgacgttcccagggagacggtggccgggctgccctggccccagtgctccaagcacttgtcgacgtctcctacactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagtctcctacactagctctgagcgggctggcaaggc

SEQ ID NO: 2841 - DNA, 495 bp, Artificial Sequence
  Synthetic Template Oligonucleotide for IgH VJ Locus
gcctccctcgcgccatcaggtctcctaggtcaactccagccacacagacccccgggctgagacccaggcagggaggggtgacgttcccagggagacggtggccgggctgccctggccccagtgctccaagcacttgtcgacgtctcctaggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagtctcctaggtcaactctgagcgggctggcaaggc

SEQ ID NO: 2842 - DNA, 495 bp, Artificial Sequence
  Synthetic Template Oligonucleotide for IgH VJ Locus
gcctccctcgcgccatcaggtctcctatacgtacgccagccacacagacccccgggctgagacccaggcagggaggggtgacgttcccagggagacggtggccgggctgccctggccccagtgctccaagcacttgtcgacgtctcctatacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgtctcctatacgtacgctgagcgggctggcaaggc

SEQ ID NO: 2843 - DNA, 495 bp, Artificial Sequence
  Synthetic Template Oligonucleotide for IgH VJ Locus
gcctccctcgcgccatcaggtctcctaatgacaccccagccacacagacccccgggctgagacccaggcagggaggggtgacgttcccagggagacggtggccgggctgccctggccccagtgctccaagcacttgtcgacgtctcctaatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggtctcctaatgacaccctgagcgggctggcaaggc

SEQ ID NO: 2844 - DNA, 495 bp, Artificial Sequence
  Synthetic Template Oligonucleotide for IgH VJ Locus
gcctccctcgcgccatcaggtctcctacttcacgaccagccacacagacccccgggctgagacccaggcagggaggggtgacgttcccagggagacggtggccgggctgccctggccccagtgctccaagcacttgtcgacgtctcctacttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgtctcctacttcacgactgagcgggctggcaaggc

SEQ ID NO: 2845 - DNA, 495 bp, Artificial Sequence
  Synthetic Template Oligonucleotide for IgH VJ Locus
gcctccctcgcgccatcaggtctcctaagaatcagccagccacacagacccccgggctgagacccaggcagggaggggtgacgttcccagggagacggtggccgggctgccctggccccagtgctccaagcacttgtcgacgtctcctaagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgtctcctaagaatcagctgagcgggctggcaaggc

SEQ ID NO: 2846 - DNA, 495 bp, Artificial Sequence
  Synthetic Template Oligonucleotide for IgH VJ Locus
gcctccctcgcgccatcaggtctcctaagttatgcccagccacacagacccccgggctgagacccaggcagggaggggtgacgttcccagggagacggtggccgggctgccctggccccagtgctccaagcacttgtcgacgtctcctaagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagtctcctaagttatgcctgagcgggctggcaaggc

SEQ ID NO: 2847 - DNA, 495 bp, Artificial Sequence
  Synthetic Template Oligonucleotide for IgH VJ Locus
gcctccctcgcgccatcaggtctcctaaggtctcaccagccacacagacccccgggctgagacccaggcagggaggggtgacgttcccagggagacggtggccgggctgccctggccccagtgctccaagcacttgtcgacgtctcctaaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgtctcctaaggtctcactgagcgggctggcaaggc

SEQ ID NO: 2848 - DNA, 495 bp, Artificial Sequence
  Synthetic Template Oligonucleotide for IgH VJ Locus
gcctccctcgcgccatcaggtctcctagtcatagtccagccacacagacccccgggctgagacccaggcagggaggggtgacgttcccagggagacggtggccgggctgccctggccccagtgctccaagcacttgtcgacgtctcctagtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgtctcctagtcatagtctgagcgggctggcaaggc

SEQ ID NO: 2849 - DNA, 495 bp, Artificial Sequence
  Synthetic Template Oligonucleotide for IgH VJ Locus
gcctccctcgcgccatcaggtctcctagtgacttgccagccacacagacccccgggctgagacccaggcagggaggggtgacgttcccagggagacggtggccgggctgccctggccccagtgctccaagcacttgtcgacgtctcctagtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggtctcctagtgacttgctgagcgggctggcaaggc

SEQ ID NO: 2850 - DNA, 495 bp, Artificial Sequence
  Synthetic Template Oligonucleotide for IgH VJ Locus
gcctccctcgcgccatcaggtctcctagattgcagccagccacacagacccccgggctgagacccaggcagggaggggtgacgttcccagggagacggtggccgggctgccctggccccagtgctccaagcacttgtcgacgtctcctagattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgtctcctagattgcagctgagcgggctggcaaggc

SEQ ID NO: 2851 - DNA, 495 bp, Artificial Sequence
  Synthetic Template Oligonucleotide for IgH VJ Locus
gcctccctcgcgccatcaggtctcctaactatgacccagccacacagacccccgggctgagacccaggcagggaggggtgacgttcccagggagacggtggccgggctgccctggccccagtgctccaagcacttgtcgacgtctcctaactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgtctcctaactatgacctgagcgggctggcaaggc

SEQ ID NO: 2852 - DNA, 495 bp, Artificial Sequence
  Synthetic Template Oligonucleotide for IgH VJ Locus
gcctccctcgcgccatcaggtctcctaatggtcaaccagccacacagacccccgggctgagacccaggcagggaggggtgacgttcccagggagacggtggccgggctgccctggccccagtgctccaagcacttgtcgacgtctcctaatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgtctcctaatggtcaactgagcgggctggcaaggc

SEQ ID NO: 2853 - DNA, 495 bp, Artificial Sequence
  Synthetic Template Oligonucleotide for IgH VJ Locus
gcctccctcgcgccatcaggtctcctagatggcttccagccacacagacccccgggctgagacccaggcagggaggggtgacgttcccagggagacggtggccgggctgccctggccccagtgctccaagcacttgtcgacgtctcctagatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgtctcctagatggcttctgagcgggctggcaaggc

SEQ ID NO: 2854 - DNA, 495 bp, Artificial Sequence
  Synthetic Template Oligonucleotide for IgH VJ Locus
gcctccctcgcgccatcaggtctcctaagcatatgccagccacacagacccccgggctgagacccaggcagggaggggtgacgttcccagggagacggtggccgggctgccctggccccagtgctccaagcacttgtcgacgtctcctaagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgtctcctaagcatatgctgagcgggctggcaaggc

SEQ ID NO: 2855 - DNA, 495 bp, Artificial Sequence
  Synthetic Template Oligonucleotide for IgH VJ Locus
gcctccctcgcgccatcaggtctcctacatatgctccagccacacagacccccgggctgagacccaggcagggaggggtgacgttcccagggagacggtggccgggctgccctggccccagtgctccaagcacttgtcgacgtctcctacatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggtctcctacatatgctctgagcgggctggcaaggc

SEQ ID NO: 2856 - DNA, 495 bp, Artificial Sequence
  Synthetic Template Oligonucleotide for IgH VJ Locus
gcctccctcgcgccatcaggtctcctatcgtcgatccagccacacagacccccgggctgagacccaggcagggaggggtgacgttcccagggagacggtggccgggctgccctggccccagtgctccaagcacttgtcgacgtctcctatcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgtctcctatcgtcgatctgagcgggctggcaaggc

SEQ ID NO: 2857 - DNA, 495 bp, Artificial Sequence
  Synthetic Template Oligonucleotide for IgH VJ Locus
gcctccctcgcgccatcaggtctcctacagtctgtccagccacacagacccccgggctgagacccaggcagggaggggtgacgttcccagggagacggtggccgggctgccctggccccagtgctccaagcacttgtcgacgtctcctacagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgtctcctacagtctgtctgagcgggctggcaaggc

SEQ ID NO: 2858 - DNA, 495 bp, Artificial Sequence
  Synthetic Template Oligonucleotide for IgH VJ Locus
gcctccctcgcgccatcaggtctcctaaacgcgtaccagccacacagacccccgggctgagacccaggcagggaggggtgacgttcccagggagacggtggccgggctgccctggccccagtgctccaagcacttgtcgacgtctcctaaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggtctcctaaacgcgtactgagcgggctggcaaggc

SEQ ID NO: 2859 - DNA, 495 bp, Artificial Sequence
  Synthetic Template Oligonucleotide for IgH VJ Locus
gcctccctcgcgccatcaggtctcctagtagttcgccagccacacagacccccgggctgagacccaggcagggaggggtgacgttcccagggagacggtggccgggctgccctggccccagtgctccaagcacttgtcgacgtctcctagtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgtctcctagtagttcgctgagcgggctggcaaggc

SEQ ID NO: 2860 - DNA, 495 bp, Artificial Sequence
  Synthetic Template Oligonucleotide for IgH VJ Locus
gcctccctcgcgccatcaggtctcctacgaactacccagccacacagacccccgggctgagacccaggcagggaggggtgacgttcccagggagacggtggccgggctgccctggccccagtgctccaagcacttgtcgacgtctcctacgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgtctcctacgaactacctgagcgggctggcaaggc

SEQ ID NO: 2861 - DNA, 495 bp, Artificial Sequence
  Synthetic Template Oligonucleotide for IgH VJ Locus
gcctccctcgcgccatcaggtctcctattaacgtcccagccacacagacccccgggctgagacccaggcagggaggggtgacgttcccagggagacggtggccgggctgccctggccccagtgctccaagcacttgtcgacgtctcctattaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgtctcctattaacgtcctgagcgggctggcaaggc

SEQ ID NO: 2862 - DNA, 495 bp, Artificial Sequence
  Synthetic Template Oligonucleotide for IgH VJ Locus
gcctccctcgcgccatcaggtctcctaagcaacctccagccacacagacccccgggctgagacccaggcagggaggggtgacgttcccagggagacggtggccgggctgccctggccccagtgctccaagcacttgtcgacgtctcctaagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgtctcctaagcaacctctgagcgggctggcaaggc

SEQ ID NO: 2863 - DNA, 495 bp, Artificial Sequence
  Synthetic Template Oligonucleotide for IgH VJ Locus
gcctccctcgcgccatcaggtctcctattctcgagccagccacacagacccccgggctgagacccaggcagggaggggtgacgttcccagggagacggtggccgggctgccctggccccagtgctccaagcacttgtcgacgtctcctattctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgtctcctattctcgagctgagcgggctggcaaggc

SEQ ID NO: 2864 - DNA, 495 bp, Artificial Sequence
  Synthetic Template Oligonucleotide for IgH VJ Locus
gcctccctcgcgccatcaggtctcctaactctacgccagccacacagacccccgggctgagacccaggcagggaggggtgacgttcccagggagacggtggccgggctgccctggccccagtgctccaagcacttgtcgacgtctcctaactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgtctcctaactctacgctgagcgggctggcaaggc

SEQ ID NO: 2865 - DNA, 495 bp, Artificial Sequence
  Synthetic Template Oligonucleotide for IgH VJ Locus
gcctccctcgcgccatcaggtctcctataccggaaccagccacacagacccccgggctgagacccaggcagggaggggtgacgttcccagggagacggtggccgggctgccctggccccagtgctccaagcacttgtcgacgtctcctataccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgtctcctataccggaactgagcgggctggcaaggc

SEQ ID NO: 2866 - DNA, 495 bp, Artificial Sequence
  Synthetic Template Oligonucleotide for IgH VJ Locus
gcctccctcgcgccatcaggtctcctacgaattgcccagccacacagacccccgggctgagacccaggcagggaggggtgacgttcccagggagacggtggccgggctgccctggccccagtgctccaagcacttgtcgacgtctcctacgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgtctcctacgaattgcctgagcgggctggcaaggc

SEQ ID NO: 2867 - DNA, 495 bp, Artificial Sequence
  Synthetic Template Oligonucleotide for IgH VJ Locus
gcctccctcgcgccatcaggtctcctattcgctcaccagccacacagacccccgggctgagacccaggcagggaggggtgacgttcccagggagacggtggccgggctgccctggccccagtgctccaagcacttgtcgacgtctcctattcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagtctcctattcgctcactgagcgggctggcaaggc

SEQ ID NO: 2868 - DNA, 495 bp, Artificial Sequence
  Synthetic Template Oligonucleotide for IgH VJ Locus
gcctccctcgcgccatcaggtctcctagacgttaaccagccacacagacccccgggctgagacccaggcagggaggggtgacgttcccagggagacggtggccgggctgccctggccccagtgctccaagcacttgtcgacgtctcctagacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggtctcctagacgttaactgagcgggctggcaaggc

SEQ ID NO: 2869 - DNA, 495 bp, Artificial Sequence
  Synthetic Template Oligonucleotide for IgH VJ Locus
gcctccctcgcgccatcaggtctcctacgtagagtccagccacacagacccccgggctgagacccaggcagggaggggtgacgttcccagggagacggtggccgggctgccctggccccagtgctccaagcacttgtcgacgtctcctacgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgtctcctacgtagagtctgagcgggctggcaaggc

SEQ ID NO: 2870 - DNA, 495 bp, Artificial Sequence
  Synthetic Template Oligonucleotide for IgH VJ Locus
gcctccctcgcgccatcaggtctcctattccggtaccagccacacagacccccgggctgagacccaggcagggaggggtgacgttcccagggagacggtggccgggctgccctggccccagtgctccaagcacttgtcgacgtctcctattccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgtctcctattccggtactgagcgggctggcaaggc

SEQ ID NO: 2871 - DNA, 495 bp, Artificial Sequence
  Synthetic Template Oligonucleotide for IgH VJ Locus
gcctccctcgcgccatcaggtctcctagcaattcgccagccacacagacccccgggctgagacccaggcagggaggggtgacgttcccagggagacggtggccgggctgccctggccccagtgctccaagcacttgtcgacgtctcctagcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgtctcctagcaattcgctgagcgggctggcaaggc

SEQ ID NO: 2872 - DNA, 495 bp, Artificial Sequence
  Synthetic Template Oligonucleotide for IgH VJ Locus
gcctccctcgcgccatcaggtctcctatgagcgaaccagccacacagacccccgggctgagacccaggcagggaggggtgacgttcccagggagacggtggccgggctgccctggccccagtgctccaagcacttgtcgacgtctcctatgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgtctcctatgagcgaactgagcgggctggcaaggc

SEQ ID NO: 2873 - DNA, 495 bp, Artificial Sequence
  Synthetic Template Oligonucleotide for IgH VJ Locus
gcctccctcgcgccatcaggtctcctatactaagcccagccacacagacccccgggctgagacccaggcagggaggggtgacgttcccagggagacggtggccgggctgccctggccccagtgctccaagcacttgtcgacgtctcctatactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgtctcctatactaagcctgagcgggctggcaaggc

SEQ ID NO: 2874 - DNA, 495 bp, Artificial Sequence
  Synthetic Template Oligonucleotide for IgH VJ Locus
gcctccctcgcgccatcaggtctcctatggcgtatccagccacacagacccccgggctgagacccaggcagggaggggtgacgttcccagggagacggtggccgggctgccctggccccagtgctccaagcacttgtcgacgtctcctatggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgtctcctatggcgtatctgagcgggctggcaaggc

SEQ ID NO: 2875 - DNA, 495 bp, Artificial Sequence
  Synthetic Template Oligonucleotide for IgH VJ Locus
gcctccctcgcgccatcaggtctcctagataaccaccagccacacagacccccgggctgagacccaggcagggaggggtgacgttcccagggagacggtggccgggctgccctggccccagtgctccaagcacttgtcgacgtctcctagataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggtctcctagataaccactgagcgggctggcaaggc

SEQ ID NO: 2876 - DNA, 495 bp, Artificial Sequence
  Synthetic Template Oligonucleotide for IgH VJ Locus
gcctccctcgcgccatcaggtctcctactagtgaaccagccacacagacccccgggctgagacccaggcagggaggggtgacgttcccagggagacggtggccgggctgccctggccccagtgctccaagcacttgtcgacgtctcctactagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggtctcctactagtgaactgagcgggctggcaaggc

SEQ ID NO: 2877 - DNA, 495 bp, Artificial Sequence
  Synthetic Template Oligonucleotide for IgH VJ Locus
gcctccctcgcgccatcaggtctcctaacgttcacccagccacacagacccccgggctgagacccaggcagggaggggtgacgttcccagggagacggtggccgggctgccctggccccagtgctccaagcacttgtcgacgtctcctaacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgtctcctaacgttcacctgagcgggctggcaaggc

SEQ ID NO: 2878 - DNA, 448 bp, Artificial Sequence
  Synthetic Template Oligonucleotide for IgH VJ Locus
gcctccctcgcgccatcaggtctcctaattacgctccagccacacagacccccgggctgagacccaggcagggaggggtgacgttcccagggagacggtggccgggctgccctggccccagtgctccaagcacttgtcgacgtctcctaattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagtctcctaattacgctctgagcgggctggcaaggc

SEQ ID NO: 2879 - DNA, 495 bp, Artificial Sequence
  Synthetic Template Oligonucleotide for IgH VJ Locus
gcctccctcgcgccatcaggtctcctacattgagtccagccacacagacccccgggctgagacccaggcagggaggggtgacgttcccagggagacggtggccgggctgccctggccccagtgctccaagcacttgtcgacgtctcctacattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgtctcctacattgagtctgagcgggctggcaaggc

SEQ ID NO: 2880 - DNA, 495 bp, Artificial Sequence
  Synthetic Template Oligonucleotide for IgH VJ Locus
gcctccctcgcgccatcaggtagacaccttggttacctgcccttctcatggaaccctctgctggcctcccacgtaccccacattctggcctgacccctcagaagccagaccactgtcggcctgggaagtccaactgtcgacgtagacaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgtagacaccttggttactgagcgggctggcaaggc

SEQ ID NO: 2881 - DNA, 495 bp, Artificial Sequence
  Synthetic Template Oligonucleotide for IgH VJ Locus
gcctccctcgcgccatcaggtagacacacctcttgcctgcccttctcatggaaccctctgctggcctcccacgtaccccacattctggcctgacccctcagaagccagaccactgtcggcctgggaagtccaactgtcgacgtagacacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgtagacacacctcttgctgagcgggctggcaaggc

SEQ ID NO: 2882 - DNA, 495 bp, Artificial Sequence
  Synthetic Template Oligonucleotide for IgH VJ Locus
gcctccctcgcgccatcaggtagacacctgattctcctgcccttctcatggaaccctctgctggcctcccacgtaccccacattctggcctgacccctcagaagccagaccactgtcggcctgggaagtccaactgtcgacgtagacacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgtagacacctgattctctgagcgggctggcaaggc

SEQ ID NO: 2883 - DNA, 495 bp, Artificial Sequence
  Synthetic Template Oligonucleotide for IgH VJ Locus
gcctccctcgcgccatcaggtagacacagtaccgacctgcccttctcatggaaccctctgctggcctcccacgtaccccacattctggcctgacccctcagaagccagaccactgtcggcctgggaagtccaactgtcgacgtagacacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgtagacacagtaccgactgagcgggctggcaaggc

SEQ ID NO: 2884 - DNA, 495 bp, Artificial Sequence
  Synthetic Template Oligonucleotide for IgH VJ Locus
gcctccctcgcgccatcaggtagacacatccatggcctgcccttctcatggaaccctctgctggcctcccacgtaccccacattctggcctgacccctcagaagccagaccactgtcggcctgggaagtccaactgtcgacgtagacacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgtagacacatccatggctgagcgggctggcaaggc

SEQ ID NO: 2885 - DNA, 495 bp, Artificial Sequence
  Synthetic Template Oligonucleotide for IgH VJ Locus
gcctccctcgcgccatcaggtagacacgtagcagtcctgcccttctcatggaaccctctgctggcctcccacgtaccccacattctggcctgacccctcagaagccagaccactgtcggcctgggaagtccaactgtcgacgtagacacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgtagacacgtagcagtctgagcgggctggcaaggc

SEQ ID NO: 2886 - DNA, 495 bp, Artificial Sequence
  Synthetic Template Oligonucleotide for IgH VJ Locus
gcctccctcgcgccatcaggtagacacatcttcgtcctgcccttctcatggaaccctctgctggcctcccacgtaccccacattctggcctgacccctcagaagccagaccactgtcggcctgggaagtccaactgtcgacgtagacacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgtagacacatcttcgtctgagcgggctggcaaggc

SEQ ID NO: 2887 - DNA, 495 bp, Artificial Sequence
  Synthetic Template Oligonucleotide for IgH VJ Locus
gcctccctcgcgccatcaggtagacactccacagtcctgcccttctcatggaaccctctgctggcctcccacgtaccccacattctggcctgacccctcagaagccagaccactgtcggcctgggaagtccaactgtcgacgtagacactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgtagacactccacagtctgagcgggctggcaaggc

SEQ ID NO: 2888 - DNA, 495 bp, Artificial Sequence
  Synthetic Template Oligonucleotide for IgH VJ Locus
gcctccctcgcgccatcaggtagacacagctagtgcctgcccttctcatggaaccctctgctggcctcccacgtaccccacattctggcctgacccctcagaagccagaccactgtcggcctgggaagtccaactgtcgacgtagacacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgtagacacagctagtgctgagcgggctggcaaggc

SEQ ID NO: 2889 - DNA, 495 bp, Artificial Sequence
  Synthetic Template Oligonucleotide for IgH VJ Locus
gcctccctcgcgccatcaggtagacactaaccaagcctgcccttctcatggaaccctctgctggcctcccacgtaccccacattctggcctgacccctcagaagccagaccactgtcggcctgggaagtccaactgtcgacgtagacactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgtagacactaaccaagctgagcgggctggcaaggc

SEQ ID NO: 2890 - DNA, 495 bp, Artificial Sequence
  Synthetic Template Oligonucleotide for IgH VJ Locus
gcctccctcgcgccatcaggtagacaccaagaggtcctgcccttctcatggaaccctctgctggcctcccacgtaccccacattctggcctgacccctcagaagccagaccactgtcggcctgggaagtccaactgtcgacgtagacaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgtagacaccaagaggtctgagcgggctggcaaggc

SEQ ID NO: 2891 - DNA, 495 bp, Artificial Sequence
  Synthetic Template Oligonucleotide for IgH VJ Locus
gcctccctcgcgccatcaggtagacacagttgacccctgcccttctcatggaaccctctgctggcctcccacgtaccccacattctggcctgacccctcagaagccagaccactgtcggcctgggaagtccaactgtcgacgtagacacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagtagacacagttgaccctgagcgggctggcaaggc

SEQ ID NO: 2892 - DNA, 495 bp, Artificial Sequence
  Synthetic Template Oligonucleotide for IgH VJ Locus
gcctccctcgcgccatcaggtagacaccagcatatcctgcccttctcatggaaccctctgctggcctcccacgtaccccacattctggcctgacccctcagaagccagaccactgtcggcctgggaagtccaactgtcgacgtagacaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagtagacaccagcatatctgagcgggctggcaaggc

SEQ ID NO: 2893 - DNA, 495 bp, Artificial Sequence
  Synthetic Template Oligonucleotide for IgH VJ Locus
gcctccctcgcgccatcaggtagacacgcaggattcctgcccttctcatggaaccctctgctggcctcccacgtaccccacattctggcctgacccctcagaagccagaccactgtcggcctgggaagtccaactgtcgacgtagacacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagtagacacgcaggattctgagcgggctggcaaggc

SEQ ID NO: 2894 - DNA, 495 bp, Artificial Sequence
  Synthetic Template Oligonucleotide for IgH VJ Locus
gcctccctcgcgccatcaggtagacacgtccattccctgcccttctcatggaaccctctgctggcctcccacgtaccccacattctggcctgacccctcagaagccagaccactgtcggcctgggaagtccaactgtcgacgtagacacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgtagacacgtccattcctgagcgggctggcaaggc

SEQ ID NO: 2895 - DNA, 495 bp, Artificial Sequence
  Synthetic Template Oligonucleotide for IgH VJ Locus
gcctccctcgcgccatcaggtagacacgcataactcctgcccttctcatggaaccctctgctggcctcccacgtaccccacattctggcctgacccctcagaagccagaccactgtcggcctgggaagtccaactgtcgacgtagacacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgtagacacgcataactctgagcgggctggcaaggc

SEQ ID NO: 2896 - DNA, 495 bp, Artificial Sequence
  Synthetic Template Oligonucleotide for IgH VJ Locus
gcctccctcgcgccatcaggtagacacatatgctgcctgcccttctcatggaaccctctgctggcctcccacgtaccccacattctggcctgacccctcagaagccagaccactgtcggcctgggaagtccaactgtcgacgtagacacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgtagacacatatgctgctgagcgggctggcaaggc

SEQ ID NO: 2897 - DNA, 495 bp, Artificial Sequence
  Synthetic Template Oligonucleotide for IgH VJ Locus
gcctccctcgcgccatcaggtagacacaatcctgccctgcccttctcatggaaccctctgctggcctcccacgtaccccacattctggcctgacccctcagaagccagaccactgtcggcctgggaagtccaactgtcgacgtagacacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgtagacacaatcctgcctgagcgggctggcaaggc

SEQ ID NO: 2898 - DNA, 495 bp, Artificial Sequence
  Synthetic Template Oligonucleotide for IgH VJ Locus
gcctccctcgcgccatcaggtagacactgagacctcctgcccttctcatggaaccctctgctggcctcccacgtaccccacattctggcctgacccctcagaagccagaccactgtcggcctgggaagtccaactgtcgacgtagacactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggtagacactgagacctctgagcgggctggcaaggc

SEQ ID NO: 2899 - DNA, 495 bp, Artificial Sequence
  Synthetic Template Oligonucleotide for IgH VJ Locus
gcctccctcgcgccatcaggtagacacgaatggaccctgcccttctcatggaaccctctgctggcctcccacgtaccccacattctggcctgacccctcagaagccagaccactgtcggcctgggaagtccaactgtcgacgtagacacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgtagacacgaatggacctgagcgggctggcaaggc

SEQ ID NO: 2900 - DNA, 495 bp, Artificial Sequence
  Synthetic Template Oligonucleotide for IgH VJ Locus
gcctccctcgcgccatcaggtagacaccacatggacctgcccttctcatggaaccctctgctggcctcccacgtaccccacattctggcctgacccctcagaagccagaccactgtcggcctgggaagtccaactgtcgacgtagacaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgtagacaccacatggactgagcgggctggcaaggc

SEQ ID NO: 2901 - DNA, 495 bp, Artificial Sequence
  Synthetic Template Oligonucleotide for IgH VJ Locus
gcctccctcgcgccatcaggtagacacttgaccatcctgcccttctcatggaaccctctgctggcctcccacgtaccccacattctggcctgacccctcagaagccagaccactgtcggcctgggaagtccaactgtcgacgtagacacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgtagacacttgaccatctgagcgggctggcaaggc

SEQ ID NO: 2902 - DNA, 495 bp, Artificial Sequence
  Synthetic Template Oligonucleotide for IgH VJ Locus
gcctccctcgcgccatcaggtagacacaagccatccctgcccttctcatggaaccctctgctggcctcccacgtaccccacattctggcctgacccctcagaagccagaccactgtcggcctgggaagtccaactgtcgacgtagacacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgtagacacaagccatcctgagcgggctggcaaggc

SEQ ID NO: 2903 - DNA, 495 bp, Artificial Sequence
  Synthetic Template Oligonucleotide for IgH VJ Locus
gcctccctcgcgccatcaggtagacactccatgtgcctgcccttctcatggaaccctctgctggcctcccacgtaccccacattctggcctgacccctcagaagccagaccactgtcggcctgggaagtccaactgtcgacgtagacactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtagacactccatgtgctgagcgggctggcaaggc

SEQ ID NO: 2904 - DNA, 495 bp, Artificial Sequence
  Synthetic Template Oligonucleotide for IgH VJ Locus
gcctccctcgcgccatcaggtagacaccaagtcaccctgcccttctcatggaaccctctgctggcctcccacgtaccccacattctggcctgacccctcagaagccagaccactgtcggcctgggaagtccaactgtcgacgtagacaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtagacaccaagtcacctgagcgggctggcaaggc

SEQ ID NO: 2905 - DNA, 495 bp, Artificial Sequence
  Synthetic Template Oligonucleotide for IgH VJ Locus
gcctccctcgcgccatcaggtagacacctgcaatccctgcccttctcatggaaccctctgctggcctcccacgtaccccacattctggcctgacccctcagaagccagaccactgtcggcctgggaagtccaactgtcgacgtagacacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgtagacacctgcaatcctgagcgggctggcaaggc

SEQ ID NO: 2906 - DNA, 495 bp, Artificial Sequence
  Synthetic Template Oligonucleotide for IgH VJ Locus
gcctccctcgcgccatcaggtagacacatcgacgacctgcccttctcatggaaccctctgctggcctcccacgtaccccacattctggcctgacccctcagaagccagaccactgtcggcctgggaagtccaactgtcgacgtagacacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgtagacacatcgacgactgagcgggctggcaaggc

SEQ ID NO: 2907 - DNA, 495 bp, Artificial Sequence
  Synthetic Template Oligonucleotide for IgH VJ Locus
gcctccctcgcgccatcaggtagacacacagactgcctgcccttctcatggaaccctctgctggcctcccacgtaccccacattctggcctgacccctcagaagccagaccactgtcggcctgggaagtccaactgtcgacgtagacacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagtagacacacagactgctgagcgggctggcaaggc

SEQ ID NO: 2908 - DNA, 495 bp, Artificial Sequence
  Synthetic Template Oligonucleotide for IgH VJ Locus
gcctccctcgcgccatcaggtagacacccttatagcctgcccttctcatggaaccctctgctggcctcccacgtaccccacattctggcctgacccctcagaagccagaccactgtcggcctgggaagtccaactgtcgacgtagacacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgtagacacccttatagctgagcgggctggcaaggc

SEQ ID NO: 2909 - DNA, 495 bp, Artificial Sequence
  Synthetic Template Oligonucleotide for IgH VJ Locus
gcctccctcgcgccatcaggtagacactacgcgttcctgcccttctcatggaaccctctgctggcctcccacgtaccccacattctggcctgacccctcagaagccagaccactgtcggcctgggaagtccaactgtcgacgtagacactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgtagacactacgcgttctgagcgggctggcaaggc

SEQ ID NO: 2910 - DNA, 495 bp, Artificial Sequence
  Synthetic Template Oligonucleotide for IgH VJ Locus
gcctccctcgcgccatcaggtagacacctataaggcctgcccttctcatggaaccctctgctggcctcccacgtaccccacattctggcctgacccctcagaagccagaccactgtcggcctgggaagtccaactgtcgacgtagacacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggtagacacctataaggctgagcgggctggcaaggc

SEQ ID NO: 2911 - DNA, 495 bp, Artificial Sequence
  Synthetic Template Oligonucleotide for IgH VJ Locus
gcctccctcgcgccatcaggtagacactcttagtccctgcccttctcatggaaccctctgctggcctcccacgtaccccacattctggcctgacccctcagaagccagaccactgtcggcctgggaagtccaactgtcgacgtagacactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtagacactcttagtcctgagcgggctggcaaggc

SEQ ID NO: 2912 - DNA, 495 bp, Artificial Sequence
  Synthetic Template Oligonucleotide for IgH VJ Locus
gcctccctcgcgccatcaggtagacactgtctgcacctgcccttctcatggaaccctctgctggcctcccacgtaccccacattctggcctgacccctcagaagccagaccactgtcggcctgggaagtccaactgtcgacgtagacactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgtagacactgtctgcactgagcgggctggcaaggc

SEQ ID NO: 2913 - DNA, 495 bp, Artificial Sequence
  Synthetic Template Oligonucleotide for IgH VJ Locus
gcctccctcgcgccatcaggtagacacgccattaacctgcccttctcatggaaccctctgctggcctcccacgtaccccacattctggcctgacccctcagaagccagaccactgtcggcctgggaagtccaactgtcgacgtagacacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtagacacgccattaactgagcgggctggcaaggc

SEQ ID NO: 2914 - DNA, 495 bp, Artificial Sequence
  Synthetic Template Oligonucleotide for IgH VJ Locus
gcctccctcgcgccatcaggtagacacgactaagacctgcccttctcatggaaccctctgctggcctcccacgtaccccacattctggcctgacccctcagaagccagaccactgtcggcctgggaagtccaactgtcgacgtagacacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggtagacacgactaagactgagcgggctggcaaggc

SEQ ID NO: 2915 - DNA, 495 bp, Artificial Sequence
  Synthetic Template Oligonucleotide for IgH VJ Locus
gcctccctcgcgccatcaggtagacacaggttgctcctgcccttctcatggaaccctctgctggcctcccacgtaccccacattctggcctgacccctcagaagccagaccactgtcggcctgggaagtccaactgtcgacgtagacacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggtagacacaggttgctctgagcgggctggcaaggc

SEQ ID NO: 2916 - DNA, 495 bp, Artificial Sequence
  Synthetic Template Oligonucleotide for IgH VJ Locus
gcctccctcgcgccatcaggtagacacctcgagaacctgcccttctcatggaaccctctgctggcctcccacgtaccccacattctggcctgacccctcagaagccagaccactgtcggcctgggaagtccaactgtcgacgtagacacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgtagacacctcgagaactgagcgggctggcaaggc

SEQ ID NO: 2917 - DNA, 495 bp, Artificial Sequence
  Synthetic Template Oligonucleotide for IgH VJ Locus
gcctccctcgcgccatcaggtagacacttaatggccctgcccttctcatggaaccctctgctggcctcccacgtaccccacattctggcctgacccctcagaagccagaccactgtcggcctgggaagtccaactgtcgacgtagacacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgtagacacttaatggcctgagcgggctggcaaggc

SEQ ID NO: 2918 - DNA, 495 bp, Artificial Sequence
  Synthetic Template Oligonucleotide for IgH VJ Locus
gcctccctcgcgccatcaggtagacactgcagacacctgcccttctcatggaaccctctgctggcctcccacgtaccccacattctggcctgacccctcagaagccagaccactgtcggcctgggaagtccaactgtcgacgtagacactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagtagacactgcagacactgagcgggctggcaaggc

SEQ ID NO: 2919 - DNA, 495 bp, Artificial Sequence
  Synthetic Template Oligonucleotide for IgH VJ Locus
gcctccctcgcgccatcaggtagacactcactgagcctgcccttctcatggaaccctctgctggcctcccacgtaccccacattctggcctgacccctcagaagccagaccactgtcggcctgggaagtccaactgtcgacgtagacactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgtagacactcactgagctgagcgggctggcaaggc

SEQ ID NO: 2920 - DNA, 495 bp, Artificial Sequence
  Synthetic Template Oligonucleotide for IgH VJ Locus
gcctccctcgcgccatcaggtagacacgagtacgtcctgcccttctcatggaaccctctgctggcctcccacgtaccccacattctggcctgacccctcagaagccagaccactgtcggcctgggaagtccaactgtcgacgtagacacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgtagacacgagtacgtctgagcgggctggcaaggc

SEQ ID NO: 2921 - DNA, 495 bp, Artificial Sequence
  Synthetic Template Oligonucleotide for IgH VJ Locus
gcctccctcgcgccatcaggtagacacatacgccacctgcccttctcatggaaccctctgctggcctcccacgtaccccacattctggcctgacccctcagaagccagaccactgtcggcctgggaagtccaactgtcgacgtagacacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgtagacacatacgccactgagcgggctggcaaggc

SEQ ID NO: 2922 - DNA, 495 bp, Artificial Sequence
  Synthetic Template Oligonucleotide for IgH VJ Locus
gcctccctcgcgccatcaggtagacactcgcatcacctgcccttctcatggaaccctctgctggcctcccacgtaccccacattctggcctgacccctcagaagccagaccactgtcggcctgggaagtccaactgtcgacgtagacactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgtagacactcgcatcactgagcgggctggcaaggc

SEQ ID NO: 2923 - DNA, 495 bp, Artificial Sequence
  Synthetic Template Oligonucleotide for IgH VJ Locus
gcctccctcgcgccatcaggtagacaccgcttaatcctgcccttctcatggaaccctctgctggcctcccacgtaccccacattctggcctgacccctcagaagccagaccactgtcggcctgggaagtccaactgtcgacgtagacaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgtagacaccgcttaatctgagcgggctggcaaggc

SEQ ID NO: 2924 - DNA, 495 bp, Artificial Sequence
  Synthetic Template Oligonucleotide for IgH VJ Locus
gcctccctcgcgccatcaggtagacactggttatccctgcccttctcatggaaccctctgctggcctcccacgtaccccacattctggcctgacccctcagaagccagaccactgtcggcctgggaagtccaactgtcgacgtagacactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgtagacactggttatcctgagcgggctggcaaggc

SEQ ID NO: 2925 - DNA, 495 bp, Artificial Sequence
  Synthetic Template Oligonucleotide for IgH VJ Locus
gcctccctcgcgccatcaggtagacacggattgctcctgcccttctcatggaaccctctgctggcctcccacgtaccccacattctggcctgacccctcagaagccagaccactgtcggcctgggaagtccaactgtcgacgtagacacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgtagacacggattgctctgagcgggctggcaaggc

SEQ ID NO: 2926 - DNA, 495 bp, Artificial Sequence
  Synthetic Template Oligonucleotide for IgH VJ Locus
gcctccctcgcgccatcaggtagacacctcagtgacctgcccttctcatggaaccctctgctggcctcccacgtaccccacattctggcctgacccctcagaagccagaccactgtcggcctgggaagtccaactgtcgacgtagacacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgtagacacctcagtgactgagcgggctggcaaggc

SEQ ID NO: 2927 - DNA, 495 bp, Artificial Sequence
  Synthetic Template Oligonucleotide for IgH VJ Locus
gcctccctcgcgccatcaggtagacacacgtactccctgcccttctcatggaaccctctgctggcctcccacgtaccccacattctggcctgacccctcagaagccagaccactgtcggcctgggaagtccaactgtcgacgtagacacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgtagacacacgtactcctgagcgggctggcaaggc

SEQ ID NO: 2928 - DNA, 495 bp, Artificial Sequence
  Synthetic Template Oligonucleotide for IgH VJ Locus
gcctccctcgcgccatcaggtagacactgatgcgacctgcccttctcatggaaccctctgctggcctcccacgtaccccacattctggcctgacccctcagaagccagaccactgtcggcctgggaagtccaactgtcgacgtagacactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgtagacactgatgcgactgagcgggctggcaaggc

SEQ ID NO: 2929 - DNA, 495 bp, Artificial Sequence
  Synthetic Template Oligonucleotide for IgH VJ Locus
gcctccctcgcgccatcaggtagacacattaagcgcctgcccttctcatggaaccctctgctggcctcccacgtaccccacattctggcctgacccctcagaagccagaccactgtcggcctgggaagtccaactgtcgacgtagacacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgtagacacattaagcgctgagcgggctggcaaggc

SEQ ID NO: 2930 - DNA, 495 bp, Artificial Sequence
  Synthetic Template Oligonucleotide for IgH VJ Locus
gcctccctcgcgccatcaggtagacacagcaatcccctgcccttctcatggaaccctctgctggcctcccacgtaccccacattctggcctgacccctcagaagccagaccactgtcggcctgggaagtccaactgtcgacgtagacacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgtagacacagcaatccctgagcgggctggcaaggc

SEQ ID NO: 2931 - DNA, 495 bp, Artificial Sequence
  Synthetic Template Oligonucleotide for IgH VJ Locus
gcctccctcgcgccatcaggtagacacgcttagtacctgcccttctcatggaaccctctgctggcctcccacgtaccccacattctggcctgacccctcagaagccagaccactgtcggcctgggaagtccaactgtcgacgtagacacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagtagacacgcttagtactgagcgggctggcaaggc

SEQ ID NO: 2932 - DNA, 495 bp, Artificial Sequence
  Synthetic Template Oligonucleotide for IgH VJ Locus
gcctccctcgcgccatcaggtagacactgaccttgcctgcccttctcatggaaccctctgctggcctcccacgtaccccacattctggcctgacccctcagaagccagaccactgtcggcctgggaagtccaactgtcgacgtagacactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgtagacactgaccttgctgagcgggctggcaaggc

SEQ ID NO: 2933 - DNA, 495 bp, Artificial Sequence
  Synthetic Template Oligonucleotide for IgH VJ Locus
gcctccctcgcgccatcaggtagacaccaaggtcacctgcccttctcatggaaccctctgctggcctcccacgtaccccacattctggcctgacccctcagaagccagaccactgtcggcctgggaagtccaactgtcgacgtagacaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgtagacaccaaggtcactgagcgggctggcaaggc

SEQ ID NO: 2934 - DNA, 495 bp, Artificial Sequence
  Synthetic Template Oligonucleotide for IgH VJ Locus
gcctccctcgcgccatcaggtagacaccactgtaccctgcccttctcatggaaccctctgctggcctcccacgtaccccacattctggcctgacccctcagaagccagaccactgtcggcctgggaagtccaactgtcgacgtagacaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgtagacaccactgtacctgagcgggctggcaaggc

SEQ ID NO: 2935 - DNA, 495 bp, Artificial Sequence
  Synthetic Template Oligonucleotide for IgH VJ Locus
gcctccctcgcgccatcaggtagacacgatgatcccctgcccttctcatggaaccctctgctggcctcccacgtaccccacattctggcctgacccctcagaagccagaccactgtcggcctgggaagtccaactgtcgacgtagacacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggtagacacgatgatccctgagcgggctggcaaggc

SEQ ID NO: 2936 - DNA, 495 bp, Artificial Sequence
  Synthetic Template Oligonucleotide for IgH VJ Locus
gcctccctcgcgccatcaggtagacaccgccaatacctgcccttctcatggaaccctctgctggcctcccacgtaccccacattctggcctgacccctcagaagccagaccactgtcggcctgggaagtccaactgtcgacgtagacaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggtagacaccgccaatactgagcgggctggcaaggc

SEQ ID NO: 2937 - DNA, 495 bp, Artificial Sequence
  Synthetic Template Oligonucleotide for IgH VJ Locus
gcctccctcgcgccatcaggtagacactcaagcctcctgcccttctcatggaaccctctgctggcctcccacgtaccccacattctggcctgacccctcagaagccagaccactgtcggcctgggaagtccaactgtcgacgtagacactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagtagacactcaagcctctgagcgggctggcaaggc

SEQ ID NO: 2938 - DNA, 495 bp, Artificial Sequence
  Synthetic Template Oligonucleotide for IgH VJ Locus
gcctccctcgcgccatcaggtagacacacgtgtgtcctgcccttctcatggaaccctctgctggcctcccacgtaccccacattctggcctgacccctcagaagccagaccactgtcggcctgggaagtccaactgtcgacgtagacacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggtagacacacgtgtgtctgagcgggctggcaaggc

SEQ ID NO: 2939 - DNA, 495 bp, Artificial Sequence
  Synthetic Template Oligonucleotide for IgH VJ Locus
gcctccctcgcgccatcaggtagacactccgtctacctgcccttctcatggaaccctctgctggcctcccacgtaccccacattctggcctgacccctcagaagccagaccactgtcggcctgggaagtccaactgtcgacgtagacactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggtagacactccgtctactgagcgggctggcaaggc

SEQ ID NO: 2940 - DNA, 495 bp, Artificial Sequence
  Synthetic Template Oligonucleotide for IgH VJ Locus
gcctccctcgcgccatcaggtagacacaagagctgcctgcccttctcatggaaccctctgctggcctcccacgtaccccacattctggcctgacccctcagaagccagaccactgtcggcctgggaagtccaactgtcgacgtagacacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggtagacacaagagctgctgagcgggctggcaaggc

SEQ ID NO: 2941 - DNA, 495 bp, Artificial Sequence
  Synthetic Template Oligonucleotide for IgH VJ Locus
gcctccctcgcgccatcaggtagacactatcgctccctgcccttctcatggaaccctctgctggcctcccacgtaccccacattctggcctgacccctcagaagccagaccactgtcggcctgggaagtccaactgtcgacgtagacactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggtagacactatcgctcctgagcgggctggcaaggc

SEQ ID NO: 2942 - DNA, 495 bp, Artificial Sequence
  Synthetic Template Oligonucleotide for IgH VJ Locus
gcctccctcgcgccatcaggtagacactcagatgccctgcccttctcatggaaccctctgctggcctcccacgtaccccacattctggcctgacccctcagaagccagaccactgtcggcctgggaagtccaactgtcgacgtagacactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgtagacactcagatgcctgagcgggctggcaaggc

SEQ ID NO: 2943 - DNA, 495 bp, Artificial Sequence
  Synthetic Template Oligonucleotide for IgH VJ Locus
gcctccctcgcgccatcaggtagacacgtgtagcacctgcccttctcatggaaccctctgctggcctcccacgtaccccacattctggcctgacccctcagaagccagaccactgtcggcctgggaagtccaactgtcgacgtagacacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggtagacacgtgtagcactgagcgggctggcaaggc

SEQ ID NO: 2944 - DNA, 495 bp, Artificial Sequence
  Synthetic Template Oligonucleotide for IgH VJ Locus
gcctccctcgcgccatcaggtagacactggcagttcctgcccttctcatggaaccctctgctggcctcccacgtaccccacattctggcctgacccctcagaagccagaccactgtcggcctgggaagtccaactgtcgacgtagacactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggtagacactggcagttctgagcgggctggcaaggc

SEQ ID NO: 2945 - DNA, 495 bp, Artificial Sequence
  Synthetic Template Oligonucleotide for IgH VJ Locus
gcctccctcgcgccatcaggtagacaccagtccaacctgcccttctcatggaaccctctgctggcctcccacgtaccccacattctggcctgacccctcagaagccagaccactgtcggcctgggaagtccaactgtcgacgtagacaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgtagacaccagtccaactgagcgggctggcaaggc

SEQ ID NO: 2946 - DNA, 495 bp, Artificial Sequence
  Synthetic Template Oligonucleotide for IgH VJ Locus
gcctccctcgcgccatcaggtagacacgtgtctaccctgcccttctcatggaaccctctgctggcctcccacgtaccccacattctggcctgacccctcagaagccagaccactgtcggcctgggaagtccaactgtcgacgtagacacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggtagacacgtgtctacctgagcgggctggcaaggc

SEQ ID NO: 2947 - DNA, 495 bp, Artificial Sequence
  Synthetic Template Oligonucleotide for IgH VJ Locus
gcctccctcgcgccatcaggtagacacgtacagtgcctgcccttctcatggaaccctctgctggcctcccacgtaccccacattctggcctgacccctcagaagccagaccactgtcggcctgggaagtccaactgtcgacgtagacacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggtagacacgtacagtgctgagcgggctggcaaggc

SEQ ID NO: 2948 - DNA, 495 bp, Artificial Sequence
  Synthetic Template Oligonucleotide for IgH VJ Locus
gcctccctcgcgccatcaggtagacacggatcatccctgcccttctcatggaaccctctgctggcctcccacgtaccccacattctggcctgacccctcagaagccagaccactgtcggcctgggaagtccaactgtcgacgtagacacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggtagacacggatcatcctgagcgggctggcaaggc

SEQ ID NO: 2949 - DNA, 495 bp, Artificial Sequence
  Synthetic Template Oligonucleotide for IgH VJ Locus
gcctccctcgcgccatcaggtagacactattggcgcctgcccttctcatggaaccctctgctggcctcccacgtaccccacattctggcctgacccctcagaagccagaccactgtcggcctgggaagtccaactgtcgacgtagacactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagtagacactattggcgctgagcgggctggcaaggc

SEQ ID NO: 2950 - DNA, 495 bp, Artificial Sequence
  Synthetic Template Oligonucleotide for IgH VJ Locus
gcctccctcgcgccatcaggtagacacaggcttgacctgcccttctcatggaaccctctgctggcctcccacgtaccccacattctggcctgacccctcagaagccagaccactgtcggcctgggaagtccaactgtcgacgtagacacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgtagacacaggcttgactgagcgggctggcaaggc

SEQ ID NO: 2951 - DNA, 495 bp, Artificial Sequence
  Synthetic Template Oligonucleotide for IgH VJ Locus
gcctccctcgcgccatcaggtagacacacacacgtcctgcccttctcatggaaccctctgctggcctcccacgtaccccacattctggcctgacccctcagaagccagaccactgtcggcctgggaagtccaactgtcgacgtagacacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgtagacacacacacgtctgagcgggctggcaaggc

SEQ ID NO: 2952 - DNA, 495 bp, Artificial Sequence
  Synthetic Template Oligonucleotide for IgH VJ Locus
gcctccctcgcgccatcaggtagacactagacggacctgcccttctcatggaaccctctgctggcctcccacgtaccccacattctggcctgacccctcagaagccagaccactgtcggcctgggaagtccaactgtcgacgtagacactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagtagacactagacggactgagcgggctggcaaggc

SEQ ID NO: 2953 - DNA, 495 bp, Artificial Sequence
  Synthetic Template Oligonucleotide for IgH VJ Locus
gcctccctcgcgccatcaggtagacacgagcgatacctgcccttctcatggaaccctctgctggcctcccacgtaccccacattctggcctgacccctcagaagccagaccactgtcggcctgggaagtccaactgtcgacgtagacacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgtagacacgagcgatactgagcgggctggcaaggc

SEQ ID NO: 2954 - DNA, 495 bp, Artificial Sequence
  Synthetic Template Oligonucleotide for IgH VJ Locus
gcctccctcgcgccatcaggtagacacgcatctgacctgcccttctcatggaaccctctgctggcctcccacgtaccccacattctggcctgacccctcagaagccagaccactgtcggcctgggaagtccaactgtcgacgtagacacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagtagacacgcatctgactgagcgggctggcaaggc

SEQ ID NO: 2955 - DNA, 495 bp, Artificial Sequence
  Synthetic Template Oligonucleotide for IgH VJ Locus
gcctccctcgcgccatcaggtagacactgctacaccctgcccttctcatggaaccctctgctggcctcccacgtaccccacattctggcctgacccctcagaagccagaccactgtcggcctgggaagtccaactgtcgacgtagacactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggtagacactgctacacctgagcgggctggcaaggc

SEQ ID NO: 2956 - DNA, 495 bp, Artificial Sequence
  Synthetic Template Oligonucleotide for IgH VJ Locus
gcctccctcgcgccatcaggtagacacaactgccacctgcccttctcatggaaccctctgctggcctcccacgtaccccacattctggcctgacccctcagaagccagaccactgtcggcctgggaagtccaactgtcgacgtagacacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgtagacacaactgccactgagcgggctggcaaggc

SEQ ID NO: 2957 - DNA, 495 bp, Artificial Sequence
  Synthetic Template Oligonucleotide for IgH VJ Locus
gcctccctcgcgccatcaggtagacacttggactgcctgcccttctcatggaaccctctgctggcctcccacgtaccccacattctggcctgacccctcagaagccagaccactgtcggcctgggaagtccaactgtcgacgtagacacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggtagacacttggactgctgagcgggctggcaaggc

SEQ ID NO: 2958 - DNA, 495 bp, Artificial Sequence
  Synthetic Template Oligonucleotide for IgH VJ Locus
gcctccctcgcgccatcaggtagacactcggtactcctgcccttctcatggaaccctctgctggcctcccacgtaccccacattctggcctgacccctcagaagccagaccactgtcggcctgggaagtccaactgtcgacgtagacactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggtagacactcggtactctgagcgggctggcaaggc

SEQ ID NO: 2959 - DNA, 495 bp, Artificial Sequence
  Synthetic Template Oligonucleotide for IgH VJ Locus
gcctccctcgcgccatcaggtagacacccatggatcctgcccttctcatggaaccctctgctggcctcccacgtaccccacattctggcctgacccctcagaagccagaccactgtcggcctgggaagtccaactgtcgacgtagacacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgtagacacccatggatctgagcgggctggcaaggc

SEQ ID NO: 2960 - DNA, 495 bp, Artificial Sequence
  Synthetic Template Oligonucleotide for IgH VJ Locus
gcctccctcgcgccatcaggtagacacacgaagatcctgcccttctcatggaaccctctgctggcctcccacgtaccccacattctggcctgacccctcagaagccagaccactgtcggcctgggaagtccaactgtcgacgtagacacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagtagacacacgaagatctgagcgggctggcaaggc

SEQ ID NO: 2961 - DNA, 495 bp, Artificial Sequence
  Synthetic Template Oligonucleotide for IgH VJ Locus
gcctccctcgcgccatcaggtagacacactgtggacctgcccttctcatggaaccctctgctggcctcccacgtaccccacattctggcctgacccctcagaagccagaccactgtcggcctgggaagtccaactgtcgacgtagacacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgtagacacactgtggactgagcgggctggcaaggc

SEQ ID NO: 2962 - DNA, 495 bp, Artificial Sequence
  Synthetic Template Oligonucleotide for IgH VJ Locus
gcctccctcgcgccatcaggtagacacggtgtcatcctgcccttctcatggaaccctctgctggcctcccacgtaccccacattctggcctgacccctcagaagccagaccactgtcggcctgggaagtccaactgtcgacgtagacacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgtagacacggtgtcatctgagcgggctggcaaggc

SEQ ID NO: 2963 - DNA, 495 bp, Artificial Sequence
  Synthetic Template Oligonucleotide for IgH VJ Locus
gcctccctcgcgccatcaggtagacactcgtgaagcctgcccttctcatggaaccctctgctggcctcccacgtaccccacattctggcctgacccctcagaagccagaccactgtcggcctgggaagtccaactgtcgacgtagacactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggtagacactcgtgaagctgagcgggctggcaaggc

SEQ ID NO: 2964 - DNA, 495 bp, Artificial Sequence
  Synthetic Template Oligonucleotide for IgH VJ Locus
gcctccctcgcgccatcaggtagacaccactagctcctgcccttctcatggaaccctctgctggcctcccacgtaccccacattctggcctgacccctcagaagccagaccactgtcggcctgggaagtccaactgtcgacgtagacaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagtagacaccactagctctgagcgggctggcaaggc

SEQ ID NO: 2965 - DNA, 495 bp, Artificial Sequence
  Synthetic Template Oligonucleotide for IgH VJ Locus
gcctccctcgcgccatcaggtagacacggtcaactcctgcccttctcatggaaccctctgctggcctcccacgtaccccacattctggcctgacccctcagaagccagaccactgtcggcctgggaagtccaactgtcgacgtagacacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagtagacacggtcaactctgagcgggctggcaaggc

SEQ ID NO: 2966 - DNA, 495 bp, Artificial Sequence
  Synthetic Template Oligonucleotide for IgH VJ Locus
gcctccctcgcgccatcaggtagacactacgtacgcctgcccttctcatggaaccctctgctggcctcccacgtaccccacattctggcctgacccctcagaagccagaccactgtcggcctgggaagtccaactgtcgacgtagacactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgtagacactacgtacgctgagcgggctggcaaggc

SEQ ID NO: 2967 - DNA, 495 bp, Artificial Sequence
  Synthetic Template Oligonucleotide for IgH VJ Locus
gcctccctcgcgccatcaggtagacacatgacacccctgcccttctcatggaaccctctgctggcctcccacgtaccccacattctggcctgacccctcagaagccagaccactgtcggcctgggaagtccaactgtcgacgtagacacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggtagacacatgacaccctgagcgggctggcaaggc

SEQ ID NO: 2968 - DNA, 495 bp, Artificial Sequence
  Synthetic Template Oligonucleotide for IgH VJ Locus
gcctccctcgcgccatcaggtagacaccttcacgacctgcccttctcatggaaccctctgctggcctcccacgtaccccacattctggcctgacccctcagaagccagaccactgtcggcctgggaagtccaactgtcgacgtagacaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgtagacaccttcacgactgagcgggctggcaaggc

SEQ ID NO: 2969 - DNA, 495 bp, Artificial Sequence
  Synthetic Template Oligonucleotide for IgH VJ Locus
gcctccctcgcgccatcaggtagacacagaatcagcctgcccttctcatggaaccctctgctggcctcccacgtaccccacattctggcctgacccctcagaagccagaccactgtcggcctgggaagtccaactgtcgacgtagacacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgtagacacagaatcagctgagcgggctggcaaggc

SEQ ID NO: 2970 - DNA, 495 bp, Artificial Sequence
  Synthetic Template Oligonucleotide for IgH VJ Locus
gcctccctcgcgccatcaggtagacacagttatgccctgcccttctcatggaaccctctgctggcctcccacgtaccccacattctggcctgacccctcagaagccagaccactgtcggcctgggaagtccaactgtcgacgtagacacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagtagacacagttatgcctgagcgggctggcaaggc

SEQ ID NO: 2971 - DNA, 495 bp, Artificial Sequence
  Synthetic Template Oligonucleotide for IgH VJ Locus
gcctccctcgcgccatcaggtagacacaggtctcacctgcccttctcatggaaccctctgctggcctcccacgtaccccacattctggcctgacccctcagaagccagaccactgtcggcctgggaagtccaactgtcgacgtagacacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgtagacacaggtctcactgagcgggctggcaaggc

SEQ ID NO: 2972 - DNA, 495 bp, Artificial Sequence
  Synthetic Template Oligonucleotide for IgH VJ Locus
gcctccctcgcgccatcaggtagacacgtcatagtcctgcccttctcatggaaccctctgctggcctcccacgtaccccacattctggcctgacccctcagaagccagaccactgtcggcctgggaagtccaactgtcgacgtagacacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgtagacacgtcatagtctgagcgggctggcaaggc

SEQ ID NO: 2973 - DNA, 495 bp, Artificial Sequence
  Synthetic Template Oligonucleotide for IgH VJ Locus
gcctccctcgcgccatcaggtagacacgtgacttgcctgcccttctcatggaaccctctgctggcctcccacgtaccccacattctggcctgacccctcagaagccagaccactgtcggcctgggaagtccaactgtcgacgtagacacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggtagacacgtgacttgctgagcgggctggcaaggc

SEQ ID NO: 2974 - DNA, 495 bp, Artificial Sequence
  Synthetic Template Oligonucleotide for IgH VJ Locus
gcctccctcgcgccatcaggtagacacgattgcagcctgcccttctcatggaaccctctgctggcctcccacgtaccccacattctggcctgacccctcagaagccagaccactgtcggcctgggaagtccaactgtcgacgtagacacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgtagacacgattgcagctgagcgggctggcaaggc

SEQ ID NO: 2975 - DNA, 495 bp, Artificial Sequence
  Synthetic Template Oligonucleotide for IgH VJ Locus
gcctccctcgcgccatcaggtagacacactatgaccctgcccttctcatggaaccctctgctggcctcccacgtaccccacattctggcctgacccctcagaagccagaccactgtcggcctgggaagtccaactgtcgacgtagacacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgtagacacactatgacctgagcgggctggcaaggc

SEQ ID NO: 2976 - DNA, 495 bp, Artificial Sequence
  Synthetic Template Oligonucleotide for IgH VJ Locus
gcctccctcgcgccatcaggtagacacatggtcaacctgcccttctcatggaaccctctgctggcctcccacgtaccccacattctggcctgacccctcagaagccagaccactgtcggcctgggaagtccaactgtcgacgtagacacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgtagacacatggtcaactgagcgggctggcaaggc

SEQ ID NO: 2977 - DNA, 495 bp, Artificial Sequence
  Synthetic Template Oligonucleotide for IgH VJ Locus
gcctccctcgcgccatcaggtagacacgatggcttcctgcccttctcatggaaccctctgctggcctcccacgtaccccacattctggcctgacccctcagaagccagaccactgtcggcctgggaagtccaactgtcgacgtagacacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgtagacacgatggcttctgagcgggctggcaaggc

SEQ ID NO: 2978 - DNA, 495 bp, Artificial Sequence
  Synthetic Template Oligonucleotide for IgH VJ Locus
gcctccctcgcgccatcaggtagacacagcatatgcctgcccttctcatggaaccctctgctggcctcccacgtaccccacattctggcctgacccctcagaagccagaccactgtcggcctgggaagtccaactgtcgacgtagacacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgtagacacagcatatgctgagcgggctggcaaggc

SEQ ID NO: 2979 - DNA, 495 bp, Artificial Sequence
  Synthetic Template Oligonucleotide for IgH VJ Locus
gcctccctcgcgccatcaggtagacaccatatgctcctgcccttctcatggaaccctctgctggcctcccacgtaccccacattctggcctgacccctcagaagccagaccactgtcggcctgggaagtccaactgtcgacgtagacaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggtagacaccatatgctctgagcgggctggcaaggc

SEQ ID NO: 2980 - DNA, 495 bp, Artificial Sequence
  Synthetic Template Oligonucleotide for IgH VJ Locus
gcctccctcgcgccatcaggtagacactcgtcgatcctgcccttctcatggaaccctctgctggcctcccacgtaccccacattctggcctgacccctcagaagccagaccactgtcggcctgggaagtccaactgtcgacgtagacactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgtagacactcgtcgatctgagcgggctggcaaggc

SEQ ID NO: 2981 - DNA, 495 bp, Artificial Sequence
  Synthetic Template Oligonucleotide for IgH VJ Locus
gcctccctcgcgccatcaggtagacaccagtctgtcctgcccttctcatggaaccctctgctggcctcccacgtaccccacattctggcctgacccctcagaagccagaccactgtcggcctgggaagtccaactgtcgacgtagacaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgtagacaccagtctgtctgagcgggctggcaaggc

SEQ ID NO: 2982 - DNA, 495 bp, Artificial Sequence
  Synthetic Template Oligonucleotide for IgH VJ Locus
gcctccctcgcgccatcaggtagacacaacgcgtacctgcccttctcatggaaccctctgctggcctcccacgtaccccacattctggcctgacccctcagaagccagaccactgtcggcctgggaagtccaactgtcgacgtagacacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggtagacacaacgcgtactgagcgggctggcaaggc

SEQ ID NO: 2983 - DNA, 495 bp, Artificial Sequence
  Synthetic Template Oligonucleotide for IgH VJ Locus
gcctccctcgcgccatcaggtagacacgtagttcgcctgcccttctcatggaaccctctgctggcctcccacgtaccccacattctggcctgacccctcagaagccagaccactgtcggcctgggaagtccaactgtcgacgtagacacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgtagacacgtagttcgctgagcgggctggcaaggc

SEQ ID NO: 2984 - DNA, 495 bp, Artificial Sequence
  Synthetic Template Oligonucleotide for IgH VJ Locus
gcctccctcgcgccatcaggtagacaccgaactaccctgcccttctcatggaaccctctgctggcctcccacgtaccccacattctggcctgacccctcagaagccagaccactgtcggcctgggaagtccaactgtcgacgtagacaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgtagacaccgaactacctgagcgggctggcaaggc

SEQ ID NO: 2985 - DNA, 495 bp, Artificial Sequence
  Synthetic Template Oligonucleotide for IgH VJ Locus
gcctccctcgcgccatcaggtagacacttaacgtccctgcccttctcatggaaccctctgctggcctcccacgtaccccacattctggcctgacccctcagaagccagaccactgtcggcctgggaagtccaactgtcgacgtagacacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgtagacacttaacgtcctgagcgggctggcaaggc

SEQ ID NO: 2986 - DNA, 495 bp, Artificial Sequence
  Synthetic Template Oligonucleotide for IgH VJ Locus
gcctccctcgcgccatcaggtagacacagcaacctcctgcccttctcatggaaccctctgctggcctcccacgtaccccacattctggcctgacccctcagaagccagaccactgtcggcctgggaagtccaactgtcgacgtagacacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgtagacacagcaacctctgagcgggctggcaaggc

SEQ ID NO: 2987 - DNA, 495 bp, Artificial Sequence
  Synthetic Template Oligonucleotide for IgH VJ Locus
gcctccctcgcgccatcaggtagacacttctcgagcctgcccttctcatggaaccctctgctggcctcccacgtaccccacattctggcctgacccctcagaagccagaccactgtcggcctgggaagtccaactgtcgacgtagacacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgtagacacttctcgagctgagcgggctggcaaggc

SEQ ID NO: 2988 - DNA, 495 bp, Artificial Sequence
  Synthetic Template Oligonucleotide for IgH VJ Locus
gcctccctcgcgccatcaggtagacacactctacgcctgcccttctcatggaaccctctgctggcctcccacgtaccccacattctggcctgacccctcagaagccagaccactgtcggcctgggaagtccaactgtcgacgtagacacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgtagacacactctacgctgagcgggctggcaaggc

SEQ ID NO: 2989 - DNA, 495 bp, Artificial Sequence
  Synthetic Template Oligonucleotide for IgH VJ Locus
gcctccctcgcgccatcaggtagacactaccggaacctgcccttctcatggaaccctctgctggcctcccacgtaccccacattctggcctgacccctcagaagccagaccactgtcggcctgggaagtccaactgtcgacgtagacactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgtagacactaccggaactgagcgggctggcaaggc

SEQ ID NO: 2990 - DNA, 495 bp, Artificial Sequence
  Synthetic Template Oligonucleotide for IgH VJ Locus
gcctccctcgcgccatcaggtagacaccgaattgccctgcccttctcatggaaccctctgctggcctcccacgtaccccacattctggcctgacccctcagaagccagaccactgtcggcctgggaagtccaactgtcgacgtagacaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgtagacaccgaattgcctgagcgggctggcaaggc

SEQ ID NO: 2991 - DNA, 495 bp, Artificial Sequence
  Synthetic Template Oligonucleotide for IgH VJ Locus
gcctccctcgcgccatcaggtagacacttcgctcacctgcccttctcatggaaccctctgctggcctcccacgtaccccacattctggcctgacccctcagaagccagaccactgtcggcctgggaagtccaactgtcgacgtagacacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagtagacacttcgctcactgagcgggctggcaaggc

SEQ ID NO: 2992 - DNA, 495 bp, Artificial Sequence
  Synthetic Template Oligonucleotide for IgH VJ Locus
gcctccctcgcgccatcaggtagacacgacgttaacctgcccttctcatggaaccctctgctggcctcccacgtaccccacattctggcctgacccctcagaagccagaccactgtcggcctgggaagtccaactgtcgacgtagacacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggtagacacgacgttaactgagcgggctggcaaggc

SEQ ID NO: 2993 - DNA, 495 bp, Artificial Sequence
  Synthetic Template Oligonucleotide for IgH VJ Locus
gcctccctcgcgccatcaggtagacaccgtagagtcctgcccttctcatggaaccctctgctggcctcccacgtaccccacattctggcctgacccctcagaagccagaccactgtcggcctgggaagtccaactgtcgacgtagacaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgtagacaccgtagagtctgagcgggctggcaaggc

SEQ ID NO: 2994 - DNA, 495 bp, Artificial Sequence
  Synthetic Template Oligonucleotide for IgH VJ Locus
gcctccctcgcgccatcaggtagacacttccggtacctgcccttctcatggaaccctctgctggcctcccacgtaccccacattctggcctgacccctcagaagccagaccactgtcggcctgggaagtccaactgtcgacgtagacacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgtagacacttccggtactgagcgggctggcaaggc

SEQ ID NO: 2995 - DNA, 495 bp, Artificial Sequence
  Synthetic Template Oligonucleotide for IgH VJ Locus
gcctccctcgcgccatcaggtagacacgcaattcgcctgcccttctcatggaaccctctgctggcctcccacgtaccccacattctggcctgacccctcagaagccagaccactgtcggcctgggaagtccaactgtcgacgtagacacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgtagacacgcaattcgctgagcgggctggcaaggc

SEQ ID NO: 2996 - DNA, 495 bp, Artificial Sequence
  Synthetic Template Oligonucleotide for IgH VJ Locus
gcctccctcgcgccatcaggtagacactgagcgaacctgcccttctcatggaaccctctgctggcctcccacgtaccccacattctggcctgacccctcagaagccagaccactgtcggcctgggaagtccaactgtcgacgtagacactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgtagacactgagcgaactgagcgggctggcaaggc

SEQ ID NO: 2997 - DNA, 495 bp, Artificial Sequence
  Synthetic Template Oligonucleotide for IgH VJ Locus
gcctccctcgcgccatcaggtagacactactaagccctgcccttctcatggaaccctctgctggcctcccacgtaccccacattctggcctgacccctcagaagccagaccactgtcggcctgggaagtccaactgtcgacgtagacactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgtagacactactaagcctgagcgggctggcaaggc

SEQ ID NO: 2998 - DNA, 495 bp, Artificial Sequence
  Synthetic Template Oligonucleotide for IgH VJ Locus
gcctccctcgcgccatcaggtagacactggcgtatcctgcccttctcatggaaccctctgctggcctcccacgtaccccacattctggcctgacccctcagaagccagaccactgtcggcctgggaagtccaactgtcgacgtagacactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgtagacactggcgtatctgagcgggctggcaaggc

SEQ ID NO: 2999 - DNA, 495 bp, Artificial Sequence
  Synthetic Template Oligonucleotide for IgH VJ Locus
gcctccctcgcgccatcaggtagacacgataaccacctgcccttctcatggaaccctctgctggcctcccacgtaccccacattctggcctgacccctcagaagccagaccactgtcggcctgggaagtccaactgtcgacgtagacacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggtagacacgataaccactgagcgggctggcaaggc

SEQ ID NO: 3000 - DNA, 495 bp, Artificial Sequence
  Synthetic Template Oligonucleotide for IgH VJ Locus
gcctccctcgcgccatcaggtagacacctagtgaacctgcccttctcatggaaccctctgctggcctcccacgtaccccacattctggcctgacccctcagaagccagaccactgtcggcctgggaagtccaactgtcgacgtagacacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggtagacacctagtgaactgagcgggctggcaaggc

SEQ ID NO: 3001 - DNA, 495 bp, Artificial Sequence
  Synthetic Template Oligonucleotide for IgH VJ Locus
gcctccctcgcgccatcaggtagacacacgttcaccctgcccttctcatggaaccctctgctggcctcccacgtaccccacattctggcctgacccctcagaagccagaccactgtcggcctgggaagtccaactgtcgacgtagacacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgtagacacacgttcacctgagcgggctggcaaggc

SEQ ID NO: 3002 - DNA, 448 bp, Artificial Sequence
  Synthetic Template Oligonucleotide for IgH VJ Locus
gcctccctcgcgccatcaggtagacacattacgctcctgcccttctcatggaaccctctgctggcctcccacgtaccccacattctggcctgacccctcagaagccagaccactgtcggcctgggaagtccaactgtcgacgtagacacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagtagacacattacgctctgagcgggctggcaaggc

SEQ ID NO: 3003 - DNA, 495 bp, Artificial Sequence
  Synthetic Template Oligonucleotide for IgH VJ Locus
gcctccctcgcgccatcaggtagacaccattgagtcctgcccttctcatggaaccctctgctggcctcccacgtaccccacattctggcctgacccctcagaagccagaccactgtcggcctgggaagtccaactgtcgacgtagacaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgtagacaccattgagtctgagcgggctggcaaggc

SEQ ID NO: 3004 - DNA, 462 bp, Artificial Sequence
  Synthetic Template Oligonucleotide Containing Random Nucleotides
  misc_feature (320)..(327): n is a, c, g, or t
gccttgccagcccgctcagtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagnnnnnnnngtttgtgcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3005 - DNA, 462 bp, Artificial Sequence
  Synthetic Template Oligonucleotide Containing Random Nucleotides
  misc_feature (320)..(327): n is a, c, g, or t
gccttgccagcccgctcagctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtnnnnnnnnttaccgatgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3006 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3007 - DNA, 462 bp, Artificial Sequence
  Synthetic Template Oligonucleotide Containing Random Nucleotides
  misc_feature (320)..(327): n is a, c, g, or t
gccttgccagcccgctcagtcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagcnnnnnnnncacccttcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3008 - DNA, 462 bp, Artificial Sequence
  Synthetic Template Oligonucleotide Containing Random Nucleotides
  misc_feature (320)..(327): n is a, c, g, or t
gccttgccagcccgctcagcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagcnnnnnnnnctagaaccgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3009 - DNA, 462 bp, Artificial Sequence
  Synthetic Template Oligonucleotide Containing Random Nucleotides
  misc_feature (320)..(327): n is a, c, g, or t
gccttgccagcccgctcagccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagcnnnnnnnncaaaggttgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3010 - DNA, 462 bp, Artificial Sequence
  Synthetic Template Oligonucleotide Containing Random Nucleotides
  misc_feature (320)..(327): n is a, c, g, or t
gccttgccagcccgctcagccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagcnnnnnnnnaggacgtcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3011 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcnnnnnnnnatcggttcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3012 - DNA, 462 bp, Artificial Sequence
  Synthetic Template Oligonucleotide Containing Random Nucleotides
  misc_feature (320)..(327): n is a, c, g, or t
gccttgccagcccgctcagtctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcaannnnnnnngagagtacgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3013 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagannnnnnnnagtggtgagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3014 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcnnnnnnnncgtaccaggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3015 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcnnnnnnnntgtctcgcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3016 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcnnnnnnnncaatagtcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3017 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcnnnnnnnntcttgcgtgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3018 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcnnnnnnnntcatccacgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3019 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtnnnnnnnnctctatgcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3020 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtnnnnnnnngtggtgctgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3021 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtnnnnnnnnctgcatcggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3022 - DNA, 462 bp, Artificial Sequence
  Synthetic Template Oligonucleotide Containing Random Nucleotides
  misc_feature (320)..(327): n is a, c, g, or t
gccttgccagcccgctcagttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtnnnnnnnnctcacacggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3023 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtnnnnnnnnggaatgtagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3024 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtnnnnnnnnaggtgggagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3025 - DNA, 462 bp, Artificial Sequence
  Synthetic Template Oligonucleotide Containing Random Nucleotides
  misc_feature (320)..(327): n is a, c, g, or t
gccttgccagcccgctcagttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtnnnnnnnngcgtatttgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3026 - DNA, 462 bp, Artificial Sequence
  Synthetic Template Oligonucleotide Containing Random Nucleotides
  misc_feature (320)..(327): n is a, c, g, or t
gccttgccagcccgctcagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtnnnnnnnnacgctctagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3027 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtnnnnnnnngccttacggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3028 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagcnnnnnnnntcacgagggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3029 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcnnnnnnnncagagacggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3030 - DNA, 462 bp, Artificial Sequence
  Synthetic Template Oligonucleotide Containing Random Nucleotides
  misc_feature (320)..(327): n is a, c, g, or t
gccttgccagcccgctcagtccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcnnnnnnnnagacgcttgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3031 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagcnnnnnnnnttcagctcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3032 - DNA, 462 bp, Artificial Sequence
  Synthetic Template Oligonucleotide Containing Random Nucleotides
  misc_feature (320)..(327): n is a, c, g, or t
gccttgccagcccgctcagatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaannnnnnnntgaagtaggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3033 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcnnnnnnnntgaatctcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3034 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcnnnnnnnntaagtgccgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3035 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcnnnnnnnngtttacccgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3036 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcnnnnnnnnataccatggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3037 - DNA, 462 bp, Artificial Sequence
  Synthetic Template Oligonucleotide Containing Random Nucleotides
  misc_feature (320)..(327): n is a, c, g, or t
gccttgccagcccgctcagtgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtnnnnnnnntgatagccgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3038 - DNA, 462 bp, Artificial Sequence
  Synthetic Template Oligonucleotide Containing Random Nucleotides
  misc_feature (320)..(327): n is a, c, g, or t
gccttgccagcccgctcagcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcannnnnnnnaggataacgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3039 - DNA, 462 bp, Artificial Sequence
  Synthetic Template Oligonucleotide Containing Random Nucleotides
  misc_feature (320)..(327): n is a, c, g, or t
gccttgccagcccgctcagttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcnnnnnnnngtactcaagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3040 - DNA, 462 bp, Artificial Sequence
  Synthetic Template Oligonucleotide Containing Random Nucleotides
  misc_feature (320)..(327): n is a, c, g, or t
gccttgccagcccgctcagtctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtnnnnnnnnaagatcgcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3041 - DNA, 462 bp, Artificial Sequence
  Synthetic Template Oligonucleotide Containing Random Nucleotides
  misc_feature (320)..(327): n is a, c, g, or t
gccttgccagcccgctcagtctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtnnnnnnnncacttctagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3042 - DNA, 462 bp, Artificial Sequence
  Synthetic Template Oligonucleotide Containing Random Nucleotides
  misc_feature (320)..(327): n is a, c, g, or t
gccttgccagcccgctcagtctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtnnnnnnnnctgtagatgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3043 - DNA, 462 bp, Artificial Sequence
  Synthetic Template Oligonucleotide Containing Random Nucleotides
  misc_feature (320)..(327): n is a, c, g, or t
gccttgccagcccgctcagccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagcnnnnnnnntaaggctggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3044 - DNA, 462 bp, Artificial Sequence
  Synthetic Template Oligonucleotide Containing Random Nucleotides
  misc_feature (320)..(327): n is a, c, g, or t
gccttgccagcccgctcagttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcnnnnnnnnaacaagcagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3045 - DNA, 462 bp, Artificial Sequence
  Synthetic Template Oligonucleotide Containing Random Nucleotides
  misc_feature (320)..(327): n is a, c, g, or t
gccttgccagcccgctcagcccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcnnnnnnnncgatctcggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3046 - DNA, 462 bp, Artificial Sequence
  Synthetic Template Oligonucleotide Containing Random Nucleotides
  misc_feature (320)..(327): n is a, c, g, or t
gccttgccagcccgctcagtttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagcnnnnnnnntgtatagggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3047 - DNA, 462 bp, Artificial Sequence
  Synthetic Template Oligonucleotide Containing Random Nucleotides
  misc_feature (320)..(327): n is a, c, g, or t
gccttgccagcccgctcagtttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgcnnnnnnnngactccacgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3048 - DNA, 462 bp, Artificial Sequence
  Synthetic Template Oligonucleotide Containing Random Nucleotides
  misc_feature (320)..(327): n is a, c, g, or t
gccttgccagcccgctcagttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtnnnnnnnncacagcaggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3049 - DNA, 462 bp, Artificial Sequence
  Synthetic Template Oligonucleotide Containing Random Nucleotides
  misc_feature (320)..(327): n is a, c, g, or t
gccttgccagcccgctcagttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtnnnnnnnncagcttccgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3050 - DNA, 462 bp, Artificial Sequence
  Synthetic Template Oligonucleotide Containing Random Nucleotides
  misc_feature (320)..(327): n is a, c, g, or t
gccttgccagcccgctcagttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtnnnnnnnntttgcagggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3051 - DNA, 462 bp, Artificial Sequence
  Synthetic Template Oligonucleotide Containing Random Nucleotides
  misc_feature (320)..(327): n is a, c, g, or t
gccttgccagcccgctcagttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagnnnnnnnnagctgagtgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3052 - DNA, 462 bp, Artificial Sequence
  Synthetic Template Oligonucleotide Containing Random Nucleotides
  misc_feature (320)..(327): n is a, c, g, or t
gccttgccagcccgctcagcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagcnnnnnnnngtaatctggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3053 - DNA, 462 bp, Artificial Sequence
  Synthetic Template Oligonucleotide Containing Random Nucleotides
  misc_feature (320)..(327): n is a, c, g, or t
gccttgccagcccgctcagttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcnnnnnnnnaaggtgtggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3054 - DNA, 462 bp, Artificial Sequence
  Synthetic Template Oligonucleotide Containing Random Nucleotides
  misc_feature (320)..(327): n is a, c, g, or t
gccttgccagcccgctcagtttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagcnnnnnnnnggtcgttagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3055 - DNA, 462 bp, Artificial Sequence
  Synthetic Template Oligonucleotide Containing Random Nucleotides
  misc_feature (320)..(327): n is a, c, g, or t
gccttgccagcccgctcagtcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcnnnnnnnntattctgggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3056 - DNA, 462 bp, Artificial Sequence
  Synthetic Template Oligonucleotide Containing Random Nucleotides
  misc_feature (320)..(327): n is a, c, g, or t
gccttgccagcccgctcagctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcannnnnnnnggacatttgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3057 - DNA, 462 bp, Artificial Sequence
  Synthetic Template Oligonucleotide Containing Random Nucleotides
  misc_feature (320)..(327): n is a, c, g, or t
gccttgccagcccgctcagtcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtnnnnnnnngacaaatcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3058 - DNA, 462 bp, Artificial Sequence
  Synthetic Template Oligonucleotide Containing Random Nucleotides
  misc_feature (320)..(327): n is a, c, g, or t
gccttgccagcccgctcagggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctnnnnnnnngctgtttcgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3059 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3060 - DNA, 462 bp, Artificial Sequence
  Synthetic Template Oligonucleotide Containing Random Nucleotides
  misc_feature (320)..(327): n is a, c, g, or t
gccttgccagcccgctcagtgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagnnnnnnnngaaagcgagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3061 - DNA, 462 bp, Artificial Sequence
  Synthetic Template Oligonucleotide Containing Random Nucleotides
  misc_feature (320)..(327): n is a, c, g, or t
gccttgccagcccgctcagcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtnnnnnnnngctacgcagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3062 - DNA, 462 bp, Artificial Sequence
  Synthetic Template Oligonucleotide Containing Random Nucleotides
  misc_feature (320)..(327): n is a, c, g, or t
gccttgccagcccgctcagatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtnnnnnnnntagtaccagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3063 - DNA, 462 bp, Artificial Sequence
  Synthetic Template Oligonucleotide Containing Random Nucleotides
  misc_feature (320)..(327): n is a, c, g, or t
gccttgccagcccgctcagcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtnnnnnnnnagaactgggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3064 - DNA, 462 bp, Artificial Sequence
  Synthetic Template Oligonucleotide Containing Random Nucleotides
  misc_feature (320)..(327): n is a, c, g, or t
gccttgccagcccgctcagcccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtnnnnnnnntttcgacggaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3065 - DNA, 462 bp, Artificial Sequence
  Synthetic Template Oligonucleotide Containing Random Nucleotides
  misc_feature (320)..(327): n is a, c, g, or t
gccttgccagcccgctcagtcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtnnnnnnnntcctggctgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3066 - DNA, 462 bp, Artificial Sequence
  Synthetic Template Oligonucleotide Containing Random Nucleotides
  misc_feature (320)..(327): n is a, c, g, or t
gccttgccagcccgctcagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtnnnnnnnntccttgacgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3067 - DNA, 462 bp, Artificial Sequence
  Synthetic Template Oligonucleotide Containing Random Nucleotides
  misc_feature (320)..(327): n is a, c, g, or t
gccttgccagcccgctcagctaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttnnnnnnnnactagcatgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3068 - DNA, 462 bp, Artificial Sequence
  Synthetic Template Oligonucleotide Containing Random Nucleotides
  misc_feature (320)..(327): n is a, c, g, or t
gccttgccagcccgctcagatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctggnnnnnnnngcgttatagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3069 - DNA, 462 bp, Artificial Sequence
  Synthetic Template Oligonucleotide Containing Random Nucleotides
  misc_feature (320)..(327): n is a, c, g, or t
gccttgccagcccgctcagctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccnnnnnnnngtaggtgagaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3070 - DNA, 462 bp, Artificial Sequence
  Synthetic Template Oligonucleotide Containing Random Nucleotides
  misc_feature (320)..(327): n is a, c, g, or t
gccttgccagcccgctcagagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgannnnnnnntagtgcacgaaagacctatggctacaccttcggttcggggaccaggttaaccgttgtaggtaaggctgggggtctctaggaggggtgcgatgagggaggactctgtcctgggaaatctgatggcgcgagggaggc

SEQ ID NO: 3071 - DNA, 462 bp, Artificial Sequence
  Synthetic Template Oligonucleotide Containing Random Nucleotides
  misc_feature (320)..(327): n is a, c, g, or t
gccttgccagcccgctcagtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagnnnnnnnngtttgtgcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3072 - DNA, 462 bp, Artificial Sequence
  Synthetic Template Oligonucleotide Containing Random Nucleotides
  misc_feature (320)..(327): n is a, c, g, or t
gccttgccagcccgctcagctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtnnnnnnnnttaccgatacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3073 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3074 - DNA, 462 bp, Artificial Sequence
  Synthetic Template Oligonucleotide Containing Random Nucleotides
  misc_feature (320)..(327): n is a, c, g, or t
gccttgccagcccgctcagtcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagcnnnnnnnncacccttcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3075 - DNA, 462 bp, Artificial Sequence
  Synthetic Template Oligonucleotide Containing Random Nucleotides
  misc_feature (320)..(327): n is a, c, g, or t
gccttgccagcccgctcagcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagcnnnnnnnnctagaaccacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3076 - DNA, 462 bp, Artificial Sequence
  Synthetic Template Oligonucleotide Containing Random Nucleotides
  misc_feature (320)..(327): n is a, c, g, or t
gccttgccagcccgctcagccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagcnnnnnnnncaaaggttacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3077 - DNA, 462 bp, Artificial Sequence
  Synthetic Template Oligonucleotide Containing Random Nucleotides
  misc_feature (320)..(327): n is a, c, g, or t
gccttgccagcccgctcagccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagcnnnnnnnnaggacgtcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3078 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcnnnnnnnnatcggttcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3079 - DNA, 462 bp, Artificial Sequence
  Synthetic Template Oligonucleotide Containing Random Nucleotides
  misc_feature (320)..(327): n is a, c, g, or t
gccttgccagcccgctcagtctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcaannnnnnnngagagtacacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3080 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagannnnnnnnagtggtgaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3081 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcnnnnnnnncgtaccagacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3082 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcnnnnnnnntgtctcgcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3083 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcnnnnnnnncaatagtcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3084 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcnnnnnnnntcttgcgtacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3085 - DNA, 462 bp, Artificial Sequence
  Synthetic Template Oligonucleotide Containing Random Nucleotides
  misc_feature (320)..(327): n is a, c, g, or t
gccttgccagcccgctcaggcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcnnnnnnnntcatccacacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3086 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtnnnnnnnnctctatgcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3087 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtnnnnnnnngtggtgctacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3088 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtnnnnnnnnctgcatcgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3089 - DNA, 462 bp, Artificial Sequence
  Synthetic Template Oligonucleotide Containing Random Nucleotides
  misc_feature (320)..(327): n is a, c, g, or t
gccttgccagcccgctcagttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtnnnnnnnnctcacacgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3090 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtnnnnnnnnggaatgtaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3091 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtnnnnnnnnaggtgggaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3092 - DNA, 462 bp, Artificial Sequence
  Synthetic Template Oligonucleotide Containing Random Nucleotides
  misc_feature (320)..(327): n is a, c, g, or t
gccttgccagcccgctcagttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtnnnnnnnngcgtatttacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3093 - DNA, 462 bp, Artificial Sequence
  Synthetic Template Oligonucleotide Containing Random Nucleotides
  misc_feature (320)..(327): n is a, c, g, or t
gccttgccagcccgctcagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtnnnnnnnnacgctctaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3094 - DNA, 462 bp, Artificial Sequence
  Synthetic Template Oligonucleotide Containing Random Nucleotides
  misc_feature (320)..(327): n is a, c, g, or t
gccttgccagcccgctcagttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtnnnnnnnngccttacgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3095 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagcnnnnnnnntcacgaggacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3096 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcnnnnnnnncagagacgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3097 - DNA, 462 bp, Artificial Sequence
  Synthetic Template Oligonucleotide Containing Random Nucleotides
  misc_feature (320)..(327): n is a, c, g, or t
gccttgccagcccgctcagtccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcnnnnnnnnagacgcttacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3098 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagcnnnnnnnnttcagctcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3099 - DNA, 462 bp, Artificial Sequence
  Synthetic Template Oligonucleotide Containing Random Nucleotides
  misc_feature (320)..(327): n is a, c, g, or t
gccttgccagcccgctcagatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaannnnnnnntgaagtagacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3100 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcnnnnnnnntgaatctcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3101 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcnnnnnnnntaagtgccacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3102 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcnnnnnnnngtttacccacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3103 - DNA, 462 bp, Artificial Sequence
  Synthetic Template Oligonucleotide Containing Random Nucleotides
  misc_feature (320)..(327): n is a, c, g, or t
gccttgccagcccgctcagtccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcnnnnnnnnataccatgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3104 - DNA, 462 bp, Artificial Sequence
  Synthetic Template Oligonucleotide Containing Random Nucleotides
  misc_feature (320)..(327): n is a, c, g, or t
gccttgccagcccgctcagtgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtnnnnnnnntgatagccacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3105 - DNA, 462 bp, Artificial Sequence
  Synthetic Template Oligonucleotide Containing Random Nucleotides
  misc_feature (320)..(327): n is a, c, g, or t
gccttgccagcccgctcagcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcannnnnnnnaggataacacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3106 - DNA, 462 bp, Artificial Sequence
  Synthetic Template Oligonucleotide Containing Random Nucleotides
  misc_feature (320)..(327): n is a, c, g, or t
gccttgccagcccgctcagttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcnnnnnnnngtactcaaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3107 - DNA, 462 bp, Artificial Sequence
  Synthetic Template Oligonucleotide Containing Random Nucleotides
  misc_feature (320)..(327): n is a, c, g, or t
gccttgccagcccgctcagtctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtnnnnnnnnaagatcgcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3108 - DNA, 462 bp, Artificial Sequence
  Synthetic Template Oligonucleotide Containing Random Nucleotides
  misc_feature (320)..(327): n is a, c, g, or t
gccttgccagcccgctcagtctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtnnnnnnnncacttctaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3109 - DNA, 462 bp, Artificial Sequence
  Synthetic Template Oligonucleotide Containing Random Nucleotides
  misc_feature (320)..(327): n is a, c, g, or t
gccttgccagcccgctcagtctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtnnnnnnnnctgtagatacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3110 - DNA, 462 bp, Artificial Sequence
  Synthetic Template Oligonucleotide Containing Random Nucleotides
  misc_feature (320)..(327): n is a, c, g, or t
gccttgccagcccgctcagccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagcnnnnnnnntaaggctgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3111 - DNA, 462 bp, Artificial Sequence
  Synthetic Template Oligonucleotide Containing Random Nucleotides
  misc_feature (320)..(327): n is a, c, g, or t
gccttgccagcccgctcagttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcnnnnnnnnaacaagcaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3112 - DNA, 462 bp, Artificial Sequence
  Synthetic Template Oligonucleotide Containing Random Nucleotides
  misc_feature (320)..(327): n is a, c, g, or t
gccttgccagcccgctcagcccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcnnnnnnnncgatctcgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3113 - DNA, 462 bp, Artificial Sequence
  Synthetic Template Oligonucleotide Containing Random Nucleotides
  misc_feature (320)..(327): n is a, c, g, or t
gccttgccagcccgctcagtttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagcnnnnnnnntgtataggacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3114 - DNA, 462 bp, Artificial Sequence
  Synthetic Template Oligonucleotide Containing Random Nucleotides
  misc_feature (320)..(327): n is a, c, g, or t
gccttgccagcccgctcagtttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgcnnnnnnnngactccacacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3115 - DNA, 462 bp, Artificial Sequence
  Synthetic Template Oligonucleotide Containing Random Nucleotides
  misc_feature (320)..(327): n is a, c, g, or t
gccttgccagcccgctcagttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtnnnnnnnncacagcagacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3116 - DNA, 462 bp, Artificial Sequence
  Synthetic Template Oligonucleotide Containing Random Nucleotides
  misc_feature (320)..(327): n is a, c, g, or t
gccttgccagcccgctcagttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtnnnnnnnncagcttccacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3117 - DNA, 462 bp, Artificial Sequence
  Synthetic Template Oligonucleotide Containing Random Nucleotides
  misc_feature (320)..(327): n is a, c, g, or t
gccttgccagcccgctcagttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtnnnnnnnntttgcaggacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3118 - DNA, 462 bp, Artificial Sequence
  Synthetic Template Oligonucleotide Containing Random Nucleotides
  misc_feature (320)..(327): n is a, c, g, or t
gccttgccagcccgctcagttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagnnnnnnnnagctgagtacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3119 - DNA, 462 bp, Artificial Sequence
  Synthetic Template Oligonucleotide Containing Random Nucleotides
  misc_feature (320)..(327): n is a, c, g, or t
gccttgccagcccgctcagcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagcnnnnnnnngtaatctgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3120 - DNA, 462 bp, Artificial Sequence
  Synthetic Template Oligonucleotide Containing Random Nucleotides
  misc_feature (320)..(327): n is a, c, g, or t
gccttgccagcccgctcagttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcnnnnnnnnaaggtgtgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3121 - DNA, 462 bp, Artificial Sequence
  Synthetic Template Oligonucleotide Containing Random Nucleotides
  misc_feature (320)..(327): n is a, c, g, or t
gccttgccagcccgctcagtttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagcnnnnnnnnggtcgttaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3122 - DNA, 462 bp, Artificial Sequence
  Synthetic Template Oligonucleotide Containing Random Nucleotides
  misc_feature (320)..(327): n is a, c, g, or t
gccttgccagcccgctcagtcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcnnnnnnnntattctggacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3123 - DNA, 462 bp, Artificial Sequence
  Synthetic Template Oligonucleotide Containing Random Nucleotides
  misc_feature (320)..(327): n is a, c, g, or t
gccttgccagcccgctcagctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcannnnnnnnggacatttacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3124 - DNA, 462 bp, Artificial Sequence
  Synthetic Template Oligonucleotide Containing Random Nucleotides
  misc_feature (320)..(327): n is a, c, g, or t
gccttgccagcccgctcagtcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtnnnnnnnngacaaatcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3125 - DNA, 462 bp, Artificial Sequence
  Synthetic Template Oligonucleotide Containing Random Nucleotides
  misc_feature (320)..(327): n is a, c, g, or t
gccttgccagcccgctcagggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctnnnnnnnngctgtttcacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3126 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3127 - DNA, 462 bp, Artificial Sequence
  Synthetic Template Oligonucleotide Containing Random Nucleotides
  misc_feature (320)..(327): n is a, c, g, or t
gccttgccagcccgctcagtgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagnnnnnnnngaaagcgaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3128 - DNA, 462 bp, Artificial Sequence
  Synthetic Template Oligonucleotide Containing Random Nucleotides
  misc_feature (320)..(327): n is a, c, g, or t
gccttgccagcccgctcagcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtnnnnnnnngctacgcaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3129 - DNA, 462 bp, Artificial Sequence
  Synthetic Template Oligonucleotide Containing Random Nucleotides
  misc_feature (320)..(327): n is a, c, g, or t
gccttgccagcccgctcagatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtnnnnnnnntagtaccaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3130 - DNA, 462 bp, Artificial Sequence
  Synthetic Template Oligonucleotide Containing Random Nucleotides
  misc_feature (320)..(327): n is a, c, g, or t
gccttgccagcccgctcagcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtnnnnnnnnagaactggacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3131 - DNA, 462 bp, Artificial Sequence
  Synthetic Template Oligonucleotide Containing Random Nucleotides
  misc_feature (320)..(327): n is a, c, g, or t
gccttgccagcccgctcagcccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtnnnnnnnntttcgacgacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3132 - DNA, 462 bp, Artificial Sequence
  Synthetic Template Oligonucleotide Containing Random Nucleotides
  misc_feature (320)..(327): n is a, c, g, or t
gccttgccagcccgctcagtcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtnnnnnnnntcctggctacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3133 - DNA, 462 bp, Artificial Sequence
  Synthetic Template Oligonucleotide Containing Random Nucleotides
  misc_feature (320)..(327): n is a, c, g, or t
gccttgccagcccgctcagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtnnnnnnnntccttgacacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3134 - DNA, 462 bp, Artificial Sequence
  Synthetic Template Oligonucleotide Containing Random Nucleotides
  misc_feature (320)..(327): n is a, c, g, or t
gccttgccagcccgctcagctaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttnnnnnnnnactagcatacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3135 - DNA, 462 bp, Artificial Sequence
  Synthetic Template Oligonucleotide Containing Random Nucleotides
  misc_feature (320)..(327): n is a, c, g, or t
gccttgccagcccgctcagatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctggnnnnnnnngcgttataacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3136 - DNA, 462 bp, Artificial Sequence
  Synthetic Template Oligonucleotide Containing Random Nucleotides
  misc_feature (320)..(327): n is a, c, g, or t
gccttgccagcccgctcagctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccnnnnnnnngtaggtgaacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3137 - DNA, 462 bp, Artificial Sequence
  Synthetic Template Oligonucleotide Containing Random Nucleotides
  misc_feature (320)..(327): n is a, c, g, or t
gccttgccagcccgctcagagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgannnnnnnntagtgcacacaaagtcgggccaacgtcctgactttcggggccggcagcaggctgaccgtgctgggtgagttttcgcgggaccacccgggcggcgggattcaggtggaaggcggcggctgatggcgcgagggaggc

SEQ ID NO: 3138 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttcaattcgcactgaagctttctttggacaaggcaccagactcacagttgtaggtaagacatttttcaggttcttttgcagatccgtcacagggaaaagtgggtccacagctgatggcgcgagggaggc

SEQ ID NO: 3139 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttacacgcacgaaacaccatatattttggagagggaagttggctcactgttgtaggtgagtaagtcaaggctggacagctgggaacttgcaaaaaggggctggaatccagctgatggcgcgagggaggc

SEQ ID NO: 3140 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttaggtgcataatgaaaaactgttttttggcagtggaacccagctctctgtcttgggtatgtaaaagacttctttcgggatagtgtatcataaggtcggagttccaggagctgatggcgcgagggaggc

SEQ ID NO: 3141 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttttggcatcatcagccccagcattttggtgatgggactcgactctccatcctaggtaagttgcagaatcagggtggtatggccattgtcccttgaaggcagagttctctctgatggcgcgagggaggc

SEQ ID NO: 3142 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttcatacatcataattcacccctccactttgggaacgggaccaggctcactgtgacaggtatgggggctccactcttgactcgggggtgcctgggtttgactgcaatgatctgatggcgcgagggaggc

SEQ ID NO: 3143 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttccattccgacaatgagcagttcttcgggccagggacacggctcaccgtgctaggtaagaagggggctccaggtgggagagagggtgagcagcccagcctgcacgacccctgatggcgcgagggaggc

SEQ ID NO: 3144 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttcaggcttgaccggggagctgttttttggagaaggctctaggctgaccgtactgggtaaggaggcggttggggctccggagagctccgagagggcgggatgggcagaggctgatggcgcgagggaggc

SEQ ID NO: 3145 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttgtcatgcaagatacgcagtattttggcccaggcacccggctgacagtgctcggtaagcgggggctcccgctgaagccccggaactggggagggggcgccccgggacgcctgatggcgcgagggaggc

SEQ ID NO: 3146 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttgcaaagaaaaaacattcagtacttcggcgccgggacccggctctcagtgctgggtaagctggggccgccgggggaccggggacgagactgcgctcgggtttttgtgcgctgatggcgcgagggaggc

SEQ ID NO: 3147 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttctttctctgagacccagtacttcgggccaggcacgcggctcctggtgctcggtgagcgcgggctgctggggcgcgggcgcgggcggcttgggtctggtttttgcggggctgatggcgcgagggaggc

SEQ ID NO: 3148 - DNA, 462 bp, Artificial Sequence
  Synthetic Template Oligonucleotide Containing Random Nucleotides
  misc_feature (320)..(327): n is a, c, g, or t
gccttgccagcccgctcagtcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagcnnnnnnnntcccatttcgtgttagacgagcagtacttcgggccgggcaccaggctcacggtcacaggtgagattcgggcgtctccccaccttccagcccctcggtccccggagtcggagggtggctgatggcgcgagggaggc

SEQ ID NO: 3149 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacacaattcgcactgaagctttctttggacaaggcaccagactcacagttgtaggtaagacatttttcaggttcttttgcagatccgtcacagggaaaagtgggtccacagctgatggcgcgagggaggc

SEQ ID NO: 3150 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacaacacgcacgaaacaccatatattttggagagggaagttggctcactgttgtaggtgagtaagtcaaggctggacagctgggaacttgcaaaaaggggctggaatccagctgatggcgcgagggaggc

SEQ ID NO: 3151 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacaaggtgcataatgaaaaactgttttttggcagtggaacccagctctctgtcttgggtatgtaaaagacttctttcgggatagtgtatcataaggtcggagttccaggagctgatggcgcgagggaggc

SEQ ID NO: 3152 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacattggcatcatcagccccagcattttggtgatgggactcgactctccatcctaggtaagttgcagaatcagggtggtatggccattgtcccttgaaggcagagttctctctgatggcgcgagggaggc

SEQ ID NO: 3153 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacacatacatcataattcacccctccactttgggaacgggaccaggctcactgtgacaggtatgggggctccactcttgactcgggggtgcctgggtttgactgcaatgatctgatggcgcgagggaggc

SEQ ID NO: 3154 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacaccattccgacaatgagcagttcttcgggccagggacacggctcaccgtgctaggtaagaagggggctccaggtgggagagagggtgagcagcccagcctgcacgacccctgatggcgcgagggaggc

SEQ ID NO: 3155 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacacaggcttgaccggggagctgttttttggagaaggctctaggctgaccgtactgggtaaggaggcggttggggctccggagagctccgagagggcgggatgggcagaggctgatggcgcgagggaggc

SEQ ID NO: 3156 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacagtcatgcaagatacgcagtattttggcccaggcacccggctgacagtgctcggtaagcgggggctcccgctgaagccccggaactggggagggggcgccccgggacgcctgatggcgcgagggaggc

SEQ ID NO: 3157 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacagcaaagaaaaaacattcagtacttcggcgccgggacccggctctcagtgctgggtaagctggggccgccgggggaccggggacgagactgcgctcgggtttttgtgcgctgatggcgcgagggaggc

SEQ ID NO: 3158 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacactttctctgagacccagtacttcgggccaggcacgcggctcctggtgctcggtgagcgcgggctgctggggcgcgggcgcgggcggcttgggtctggtttttgcggggctgatggcgcgagggaggc

SEQ ID NO: 3159 - DNA, 462 bp, Artificial Sequence
  Synthetic Template Oligonucleotide Containing Random Nucleotides
  misc_feature (320)..(327): n is a, c, g, or t
gccttgccagcccgctcagctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagnnnnnnnntagctacacgtgttagacgagcagtacttcgggccgggcaccaggctcacggtcacaggtgagattcgggcgtctccccaccttccagcccctcggtccccggagtcggagggtggctgatggcgcgagggaggc

SEQ ID NO: 3160 - DNA, 337 bp, Artificial Sequence
  Genomic Control Synthetic Template Oligonocleotide With Random Sequences
  misc_feature (161)..(166): n is a, c, g, or t
gccttgccagcccgctcaggtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgcnnnnnnccactaccacgcaatagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtgcctccctcgcgccatcag

SEQ ID NO: 3161 - DNA, 342 bp, Artificial Sequence
  Genomic Control Synthetic Template Oligonocleotide With Random Sequences
  misc_feature (167)..(172): n is a, c, g, or t
gccttgccagcccgctcagttctccaatctggcttgcaggaaaggggtttctggggagattttaccgagcaacgtagggaaacggctgcctggctacctacccctttttgacacccacacgtgctcggcaccttacatacactgcgtgattttatcctaaagccacnnnnnntggaccagctcagggaaactgggcgtcacataaggcaagtgacctgcacagcctgctccggaggagacccgtacgatcccagagacaagcactgaacataaggcacccggcgccgcgcccgctttgcaacctctcgcgacagttgtacgtcgcctccctcgcgccatcag

SEQ ID NO: 3162 - DNA, 342 bp, Artificial Sequence
  Genomic Control Synthetic Template Oligonocleotide With Random Sequences
  misc_feature (166)..(171): n is a, c, g, or t
gccttgccagcccgctcagtagcattctcccaaggaatgaatgttttgtctctcacagatatgggacacagcaggacaggaacggttccagtctctcggtgtggccttctacagaggtgcagactgctgcgttctggtatttgatgtgactgcccccaacacattnnnnnngagtctcgtgtttaagtttctcatccaggccagtccccgagatcctgaaaacttcccatttgttgtgttgggaaacaagattgacctcgaaaacagacaagtaagtaccaacgatgatagatattgtcacagacacctgctccccaggggccgcctccctcgcgccatcag

SEQ ID NO: 3163 - DNA, 386 bp, Artificial Sequence
  Genomic Control Synthetic Template Oligonocleotide With Random Sequences
  misc_feature (186)..(191): n is a, c, g, or t
gtcgtaccgactggtagatgagccttgccagcccgctcaggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccgnnnnnngtcagttaacactacataagactcggccttagaaccccagtatcagcagaaggacattttaggacgggacttgggtgactctagggcactggttttctttccagagagcggaacaggcgaggaaaagtagtcccttctcggcgattctgcggagcctccctcgcgccatcaggactatacgcccgttttcggatc

SEQ ID NO: 3164 - DNA, 342 bp, Artificial Sequence
  Genomic Control Synthetic Template Oligonocleotide With Random Sequences
  misc_feature (166)..(171): n is a, c, g, or t
gccttgccagcccgctcagctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgcnnnnnnaatttgtggcaccgcctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcgcctccctcgcgccatcag

SEQ ID NO: 3165 - DNA, 340 bp, Artificial Sequence
  Genomic Control Synthetic Template Oligonocleotide With Random Sequences
  misc_feature (167)..(172): n is a, c, g, or t
gccttgccagcccgctcagttcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagnnnnnntaggtaagtatacctaaagacaaggccaaagagactgcagatgccatcactaaagaagcgaagaaagctaccgtgaatttactgggtgaagaaaagaagagcacctacccaactttcttgtacaaagttggcattataagaaagcattggcctccctcgcgccatcag

SEQ ID NO: 3166 - DNA, 339 bp, Artificial Sequence
  Genomic Control Synthetic Template Oligonocleotide With Random Sequences
  misc_feature (166)..(171): n is a, c, g, or t
gccttgccagcccgctcaggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaagnnnnnncgttgaattaacacttgcacaaacacggcaacactgggtggcatccaagtcttggaaaaccgtgtgaagcaactactataaacttgagtcatcccgacgttgatctcttacaactgtgtatgttaactttttagcacatgttttgtactgcctccctcgcgccatcag

SEQ ID NO: 3167 - DNA, 14 bp, Artificial Sequence
  Synthetic Template Oligonucleotide Sequencing Primer
ccactaccacgcaa

SEQ ID NO: 3168 - DNA, 14 bp, Artificial Sequence
  Synthetic Template Oligonucleotide Sequencing Primer
tggaccagctcagg

SEQ ID NO: 3169 - DNA, 14 bp, Artificial Sequence
  Synthetic Template Oligonucleotide Sequencing Primer
gagtctcgtgttta

SEQ ID NO: 3170 - DNA, 14 bp, Artificial Sequence
  Synthetic Template Oligonucleotide Sequencing Primer
gtcagttaacacta

SEQ ID NO: 3171 - DNA, 14 bp, Artificial Sequence
  Synthetic Template Oligonucleotide Sequencing Primer
aatttgtggcaccg

SEQ ID NO: 3172 - DNA, 14 bp, Artificial Sequence
  Synthetic Template Oligonucleotide Sequencing Primer
taggtaagtatacc

SEQ ID NO: 3173 - DNA, 14 bp, Artificial Sequence
  Synthetic Template Oligonucleotide Sequencing Primer
cgttgaattaacac

SEQ ID NO: 3174 - DNA, 18 bp, Artificial Sequence
  Synthetic Template Oligonucleotide Sequencing Primer
tagccatggtcaacccca

SEQ ID NO: 3175 - DNA, 17 bp, Artificial Sequence
  Synthetic Template Oligonucleotide Sequencing Primer
gaaactgggcgtcacat

SEQ ID NO: 3176 - DNA, 17 bp, Artificial Sequence
  Synthetic Template Oligonucleotide Sequencing Primer
agtttctcatccaggcc

SEQ ID NO: 3177 - DNA, 19 bp, Artificial Sequence
  Synthetic Template Oligonucleotide Sequencing Primer
cataagactcggccttaga

SEQ ID NO: 3178 - DNA, 22 bp, Artificial Sequence
  Synthetic Template Oligonucleotide Sequencing Primer
cctcgcggatcaggagccagcg

SEQ ID NO: 3179 - DNA, 15 bp, Artificial Sequence
  Synthetic Template Oligonucleotide Sequencing Primer
taaagacaaggccaa

SEQ ID NO: 3180 - DNA, 15 bp, Artificial Sequence
  Synthetic Template Oligonucleotide Sequencing Primer
ttgcacaaacacggc

SEQ ID NO: 3181 - DNA, 20 bp, Artificial Sequence
  Synthetic Template Oligonucleotide Sequencing Primer
ggcaatgtcgaagaacacgg

SEQ ID NO: 3182 - DNA, 20 bp, Artificial Sequence
  Synthetic Template Oligonucleotide Sequencing Primer
ctgtgcaggtcacttgcctt

SEQ ID NO: 3183 - DNA, 21 bp, Artificial Sequence
  Synthetic Template Oligonucleotide Sequencing Primer
gttttcaggatctcggggact

SEQ ID NO: 3184 - DNA, 20 bp, Artificial Sequence
  Synthetic Template Oligonucleotide Sequencing Primer
ccttctgctgatactggggt

SEQ ID NO: 3185 - DNA, 16 bp, Artificial Sequence
  Synthetic Template Oligonucleotide Sequencing Primer
ggcgtcgggcgaacaa

SEQ ID NO: 3186 - DNA, 20 bp, Artificial Sequence
  Synthetic Template Oligonucleotide Sequencing Primer
tgatggcatctgcagtctct

SEQ ID NO: 3187 - DNA, 20 bp, Artificial Sequence
  Synthetic Template Oligonucleotide Sequencing Primer
cttggatgccacccagtgtt

SEQ ID NO: 3188 - DNA, 20 bp, Artificial Sequence
  Synthetic Template Oligonucleotide Sequencing Primer
ccgtgttcttcgacattgcc

SEQ ID NO: 3189 - DNA, 20 bp, Artificial Sequence
  Synthetic Template Oligonucleotide Sequencing Primer
aaggcaagtgacctgcacag

SEQ ID NO: 3190 - DNA, 21 bp, Artificial Sequence
  Synthetic Template Oligonucleotide Sequencing Primer
agtccccgagatcctgaaaac

SEQ ID NO: 3191 - DNA, 20 bp, Artificial Sequence
  Synthetic Template Oligonucleotide Sequencing Primer
accccagtatcagcagaagg

SEQ ID NO: 3192 - DNA, 16 bp, Artificial Sequence
  Synthetic Template Oligonucleotide Sequencing Primer
ttgttcgcccgacgcc

SEQ ID NO: 3193 - DNA, 20 bp, Artificial Sequence
  Synthetic Template Oligonucleotide Sequencing Primer
agagactgcagatgccatca

SEQ ID NO: 3194 - DNA, 20 bp, Artificial Sequence
  Synthetic Template Oligonucleotide Sequencing Primer
aacactgggtggcatccaag

SEQ ID NO: 3195 - DNA, 43 bp, Artificial Sequence
  Control Synthetic Template Oligonucleotide Primer Sequence with Adaptor
gggctggcaagccacgtttggtgggtataaaaggggcgggagg

SEQ ID NO: 3196 - DNA, 43 bp, Artificial Sequence
  Control Synthetic Template Oligonucleotide Primer Sequence with Adaptor
gggctggcaagccacgtttggtgcgtgctcggcaccttacata

SEQ ID NO: 3197 - DNA, 43 bp, Artificial Sequence
  Control Synthetic Template Oligonucleotide Primer Sequence with Adaptor
gggctggcaagccacgtttggtgcagactgctgcgttctggta

SEQ ID NO: 3198 - DNA, 41 bp, Artificial Sequence
  Control Synthetic Template Oligonucleotide Primer Sequence with Adaptor
gggctggcaagccacgtttggtgcacgtcagacgaagggcg

SEQ ID NO: 3199 - DNA, 43 bp, Artificial Sequence
  Control Synthetic Template Oligonucleotide Primer Sequence with Adaptor
gggctggcaagccacgtttggtgtcagtctcagcgaagcgtct

SEQ ID NO: 3200 - DNA, 43 bp, Artificial Sequence
  Control Synthetic Template Oligonucleotide Primer Sequence with Adaptor
gggctggcaagccacgtttggtgactgctctacaagcgcatca

SEQ ID NO: 3201 - DNA, 43 bp, Artificial Sequence
  Control Synthetic Template Oligonucleotide Primer Sequence with Adaptor
gggctggcaagccacgtttggtgctagcagcggcagcagtaaa

SEQ ID NO: 3202 - DNA, 43 bp, Artificial Sequence
  Control Synthetic Template Oligonucleotide Primer Sequence with Adaptor
ccgggagctgcatgtgtcagaggggcaatgtcgaagaacacgg

SEQ ID NO: 3203 - DNA, 43 bp, Artificial Sequence
  Control Synthetic Template Oligonucleotide Primer Sequence with Adaptor
ccgggagctgcatgtgtcagaggctgtgcaggtcacttgcctt

SEQ ID NO: 3204 - DNA, 44 bp, Artificial Sequence
  Control Synthetic Template Oligonucleotide Primer Sequence with Adaptor
ccgggagctgcatgtgtcagagggttttcaggatctcggggact

SEQ ID NO: 3205 - DNA, 43 bp, Artificial Sequence
  Control Synthetic Template Oligonucleotide Primer Sequence with Adaptor
ccgggagctgcatgtgtcagaggccttctgctgatactggggt

SEQ ID NO: 3206 - DNA, 39 bp, Artificial Sequence
  Control Synthetic Template Oligonucleotide Primer Sequence with Adaptor
ccgggagctgcatgtgtcagaggggcgtcgggcgaacaa

SEQ ID NO: 3207 - DNA, 43 bp, Artificial Sequence
  Control Synthetic Template Oligonucleotide Primer Sequence with Adaptor
ccgggagctgcatgtgtcagaggtgatggcatctgcagtctct

SEQ ID NO: 3208 - DNA, 43 bp, Artificial Sequence
  Control Synthetic Template Oligonucleotide Primer Sequence with Adaptor
ccgggagctgcatgtgtcagaggcttggatgccacccagtgtt

SEQ ID NO: 3209 - DNA, 41 bp, Artificial Sequence
  Control Synthetic Template Oligonucleotide Primer Sequence with Adaptor
gactggttccaattgacaagcggtataaaaggggcgggagg

SEQ ID NO: 3210 - DNA, 41 bp, Artificial Sequence
  Control Synthetic Template Oligonucleotide Primer Sequence with Adaptor
gactggttccaattgacaagccgtgctcggcaccttacata

SEQ ID NO: 3211 - DNA, 41 bp, Artificial Sequence
  Control Synthetic Template Oligonucleotide Primer Sequence with Adaptor
gactggttccaattgacaagccagactgctgcgttctggta

SEQ ID NO: 3212 - DNA, 39 bp, Artificial Sequence
  Control Synthetic Template Oligonucleotide Primer Sequence with Adaptor
gactggttccaattgacaagccacgtcagacgaagggcg

SEQ ID NO: 3213 - DNA, 41 bp, Artificial Sequence
  Control Synthetic Template Oligonucleotide Primer Sequence with Adaptor
gactggttccaattgacaagctcagtctcagcgaagcgtct

SEQ ID NO: 3214 - DNA, 41 bp, Artificial Sequence
  Control Synthetic Template Oligonucleotide Primer Sequence with Adaptor
gactggttccaattgacaagcactgctctacaagcgcatca

SEQ ID NO: 3215 - DNA, 41 bp, Artificial Sequence
  Control Synthetic Template Oligonucleotide Primer Sequence with Adaptor
gactggttccaattgacaagcctagcagcggcagcagtaaa

SEQ ID NO: 3216 - DNA, 41 bp, Artificial Sequence
  Control Synthetic Template Oligonucleotide Primer Sequence with Adaptor
gcaaatggcattctgacatccggcaatgtcgaagaacacgg

SEQ ID NO: 3217 - DNA, 41 bp, Artificial Sequence
  Control Synthetic Template Oligonucleotide Primer Sequence with Adaptor
gcaaatggcattctgacatccctgtgcaggtcacttgcctt

SEQ ID NO: 3218 - DNA, 42 bp, Artificial Sequence
  Control Synthetic Template Oligonucleotide Primer Sequence with Adaptor
gcaaatggcattctgacatccgttttcaggatctcggggact

SEQ ID NO: 3219 - DNA, 41 bp, Artificial Sequence
  Control Synthetic Template Oligonucleotide Primer Sequence with Adaptor
gcaaatggcattctgacatccccttctgctgatactggggt

SEQ ID NO: 3220 - DNA, 37 bp, Artificial Sequence
  Control Synthetic Template Oligonucleotide Primer Sequence with Adaptor
gcaaatggcattctgacatccggcgtcgggcgaacaa

SEQ ID NO: 3221 - DNA, 41 bp, Artificial Sequence
  Control Synthetic Template Oligonucleotide Primer Sequence with Adaptor
gcaaatggcattctgacatcctgatggcatctgcagtctct

SEQ ID NO: 3222 - DNA, 41 bp, Artificial Sequence
  Control Synthetic Template Oligonucleotide Primer Sequence with Adaptor
gcaaatggcattctgacatcccttggatgccacccagtgtt

SEQ ID NO: 3223 - DNA, 20 bp, Artificial Sequence
  Control Synthetic Template Oligonucleotide Primer Sequence
ggtataaaaggggcgggagg

SEQ ID NO: 3224 - DNA, 20 bp, Artificial Sequence
  Control Synthetic Template Oligonucleotide Primer Sequence
cgtgctcggcaccttacata

SEQ ID NO: 3225 - DNA, 20 bp, Artificial Sequence
  Control Synthetic Template Oligonucleotide Primer Sequence
cagactgctgcgttctggta

SEQ ID NO: 3226 - DNA, 18 bp, Artificial Sequence
  Control Synthetic Template Oligonucleotide Primer Sequence
cacgtcagacgaagggcg

SEQ ID NO: 3227 - DNA, 20 bp, Artificial Sequence
  Control Synthetic Template Oligonucleotide Primer Sequence
tcagtctcagcgaagcgtct

SEQ ID NO: 3228 - DNA, 20 bp, Artificial Sequence
  Control Synthetic Template Oligonucleotide Primer Sequence
actgctctacaagcgcatca

SEQ ID NO: 3229 - DNA, 20 bp, Artificial Sequence
  Control Synthetic Template Oligonucleotide Primer Sequence
ctagcagcggcagcagtaaa

SEQ ID NO: 3230 - DNA, 20 bp, Artificial Sequence
  Control Synthetic Template Oligonucleotide Primer Sequence
ggcaatgtcgaagaacacgg

SEQ ID NO: 3231 - DNA, 20 bp, Artificial Sequence
  Control Synthetic Template Oligonucleotide Primer Sequence
ctgtgcaggtcacttgcctt

SEQ ID NO: 3232 - DNA, 21 bp, Artificial Sequence
  Control Synthetic Template Oligonucleotide Primer Sequence
gttttcaggatctcggggact

SEQ ID NO: 3233 - DNA, 20 bp, Artificial Sequence
  Control Synthetic Template Oligonucleotide Primer Sequence
ccttctgctgatactggggt

SEQ ID NO: 3234 - DNA, 16 bp, Artificial Sequence
  Control Synthetic Template Oligonucleotide Primer Sequence
ggcgtcgggcgaacaa

SEQ ID NO: 3235 - DNA, 20 bp, Artificial Sequence
  Control Synthetic Template Oligonucleotide Primer Sequence
tgatggcatctgcagtctct

SEQ ID NO: 3236 - DNA, 20 bp, Artificial Sequence
  Control Synthetic Template Oligonucleotide Primer Sequence
cttggatgccacccagtgtt

SEQ ID NO: 3237 - DNA, 23 bp, Artificial Sequence
  Adaptor Seqeunce
gggctggcaagccacgtttggtg

SEQ ID NO: 3238 - DNA, 23 bp, Artificial Sequence
  Adaptor Seqeunce
ccgggagctgcatgtgtcagagg

SEQ ID NO: 3239 - DNA, 21 bp, Artificial Sequence
  Adaptor Seqeunce
gactggttccaattgacaagc

SEQ ID NO: 3240 - DNA, 21 bp, Artificial Sequence
  Adaptor Seqeunce
gcaaatggcattctgacatcc

SEQ ID NO: 3241 - DNA, 110 bp, Artificial Sequence
  Genomic Control Synthetic Template Oligonocleotide With Random Sequences
acaatgtggccgaggactttgattgcacattgttgtttttttaatagtcattccaaatatgagatgcgttgttacaggaagtcccttgccatcctaaaagccaccccact

SEQ ID NO: 3242 - DNA, 110 bp, Artificial Sequence
  Genomic Control Synthetic Template Oligonocleotide With Random Sequences
agatgagtatgcctgccgtgtgaaccatgtgactttgtcacagcccaagatagttaagtgggatcgagacatgtaagcagcatcatggaggtttgaagatgccgcatttg

SEQ ID NO: 3243 - DNA, 110 bp, Artificial Sequence
  Genomic Control Synthetic Template Oligonocleotide With Random Sequences
ccgcttcctcttactgtcgtagttccgcgtctgagcgctcgacgctcctgggtgccattgcctgcctgagtcacgtgtcagggggaagctggaaggcgtcgttctccttt

SEQ ID NO: 3244 - DNA, 110 bp, Artificial Sequence
  Genomic Control Synthetic Template Oligonocleotide With Random Sequences
ctagcagcggcagcagtaaaacaggcaaaagtggggctggcaaaaggaggtagtcaggccgtccagagctggcatttgcacaaacacggcaacactgggtggcatccaag

SEQ ID NO: 3245 - DNA, 110 bp, Artificial Sequence
  Genomic Control Synthetic Template Oligonocleotide With Random Sequences
ggatgtgatgccagaggtcaacaaggttctggacaagatgaagtctttctgccagcgtgtccggagcggtgactggaaggggtacacaggcaagaccatcacggacgtca

SEQ ID NO: 3246 - DNA, 110 bp, Artificial Sequence
  Genomic Control Synthetic Template Oligonocleotide With Random Sequences
caacggcggaagaaaacagcccaaagatgagagtgattcgcgtgggtacccgcaagagccagcttgctcgcatacagacggacagtgtggtggcaacattgaaagcctcg

SEQ ID NO: 3247 - DNA, 110 bp, Artificial Sequence
  Genomic Control Synthetic Template Oligonocleotide With Random Sequences
tgctgaggatttggaaagggtgtttattcctcatggactaattatggacaggactgaacgtcttgctcgagatgtgatgaaggagatgggaggccatcacattgtagccc

SEQ ID NO: 3248 - DNA, 111 bp, Artificial Sequence
  Genomic Control Synthetic Template Oligonocleotide With Random Sequences
gtccactcccgattccttcatggatccggcgtctgcactttacagaggtccaatcacgcggacccagaaccccatggtgaccgggacctcagtcctcggcgttaagttcga

SEQ ID NO: 3249 - DNA, 110 bp, Artificial Sequence
  Genomic Control Synthetic Template Oligonocleotide With Random Sequences
aaggtggtggtcgtacgctgtgaaggcatcaacatttctggcaatttctacagaaacaagttgaagtacctggctttcctccgcaagcggatgaacaccaacccttcccg

SEQ ID NO: 3250 - DNA, 110 bp, Artificial Sequence
  Genomic Control Synthetic Template Oligonocleotide With Random Sequences
gagcgctatccgcggtttctgattggctactttgttcgcattataaaaggcacgcgcgggcgcgaggcccttctctcgccaggcgtcctcgtggaagtgacatcgtcttt

SEQ ID NO: 3251 - DNA, 110 bp, Artificial Sequence
  Genomic Control Synthetic Template Oligonocleotide With Random Sequences
tatgtggacgttggcactgggaaggtcactctggaatatagacccgtgatcgacaaaactttgaacgaggctgactgtgccaccgtcccgccagccattcgctcctactg

SEQ ID NO: 3252 - DNA, 110 bp, Artificial Sequence
  Genomic Control Synthetic Template Oligonocleotide With Random Sequences
aagtaggccagagccgaactctcttcctgccaagatgtctattggtgtgccgattaaagtactgcatgaggccgagggccacattgtgacatgtgagacgaacaccggtg

---

The invention claimed is:

1. A method for determining a ratio of T cells or B cells in a sample relative to the total number of input genomes contained in said sample comprising:
   A) amplifying by multiplex PCR and sequencing:
      i) rearranged CDR3 oligonucleotide sequences from T cell receptor (TCR) loci from T cells or Immunoglobulin (Ig) loci from B cells in said sample to obtain a total number of output biological sequences, each oligonucleotide sequence comprising a V segment and a J segment;
      ii) a first set of synthetic templates representing substantially all possible V segment and J segment combinations and each comprising one TCR or Ig V segment and one TCR or Ig J or C segment and a unique barcode which identifies said synthetic template as synthetic, and wherein each synthetic template comprises a unique combination of a V segment and J or C segment;
   B) determining an amplification factor for each synthetic template comprising a unique combination of a V segment and a J or C segment, wherein said amplification factor is represented by a total number of first synthetic templates observed from step A(ii) divided by a total input number of unique first synthetic templates input in step A(ii);
   C) determining the total number of T cells or B cells in the sample by dividing the total number of output biological sequences observed in step A(i) by the amplification factor from step B;
   D) amplifying by multiplex PCR and sequencing:
      i) one or more genomic control regions from DNA obtained from said sample to obtain a total number of output biological sequences for each genomic control region; and
      ii) a second set of synthetic templates comprising the sequence of one or more of said genomic control sequences, a unique barcode and a stretch of random nucleic acids, wherein each synthetic template is represented only once;
   E) determining an amplification factor for each of said genomic control region by dividing the total number of second synthetic templates amplified and sequenced in step D(ii) by the total input number of unique second synthetic templates amplified and sequenced in step D(ii);
   F) determining the total number of input genomes by dividing the total number of output biological sequences for each genomic control region from step D(i) by the corresponding amplification factor for that genomic control region from Step E; and
   G) determining the ratio of T cells or B cells contained in the sample relative to the number of total genomes in the sample by dividing the total number of T cells or B cells obtained in step C by the total number of input genomes obtained in step F.

2. The method of claim 1, wherein the first set of synthetic templates comprises the sequence of formula I: 5'-U1-B1-V-B2-J-B3-U2-3', wherein
   A) V is an oligonucleotide sequence comprising at least 20 and not more than 1000 contiguous nucleotides of a TCR or Ig variable (V) region encoding gene sequence, or the complement thereof and each template in set first set of synthetic templates having a unique V-region oligonucleotide sequence;
   B) J is an oligonucleotide sequence comprising at least 15 and not more than 600 contiguous nucleotides of a TCR or Ig joining (J) region encoding gene sequence, or the complement thereof and each template in said first set of synthetic templates comprising a unique J-region oligonucleotide sequence;

C) U1 comprises an oligonucleotide sequence that is selected from (i) a first universal adaptor oligonucleotide sequence; and (ii) a first sequencing platform oligonucleotide sequence that is linked to and positioned 5' to a first universal adaptor oligonucleotide sequence;

D) U2 comprises an oligonucleotide sequence that is selected from (i) a second universal adaptor oligonucleotide sequence; and (ii) a second sequencing platform oligonucleotide sequence that is linked to and positioned 5' to a second universal adaptor oligonucleotide sequence; and E) B1, B2 and B3 each independently comprise either nothing or an oligonucleotide barcode sequence of 3-25 nucleic acids that uniquely identifies, as a pair combination (i) said unique V-region oligonucleotide sequence; and said unique J-region oligonucleotide, wherein at least one of B1, B2 and B3 is present in each synthetic template contained in said first set of oligonucleotides.

3. The method of claim 2, wherein each of the synthetic templates contained in said first set of synthetic templates further comprises a stretch of unique random nucleotides.

4. The method of claim 3, wherein the random stretch of nucleotides comprise from 4 to 50 nucleotides, or wherein the random stretch of nucleotides comprises 8 nucleotides.

5. The method of claim 1, wherein the total number of synthetic templates in said first set of synthetic templates subject to amplification in step A(ii) is determined using a limiting dilution of said synthetic templates each comprising a unique TCR or Ig V and J or C region such that the number of observed unique synthetic templates allows inference of the total number of input synthetic template molecules.

6. The method of claim 3, wherein the total number of synthetic templates in said first set of synthetic templates subject to amplification in step A(ii) is determined by counting the number of unique synthetic templates based on the unique random nucleotides contained in each synthetic template.

7. The method of claim 1, comprising amplifying by multiplex PCR and sequencing two or more, or three or more, or four or more, or five or more genomic control regions in step D(i).

8. The method of claim 1, comprising amplifying by multiplex PCR and sequencing five genomic control regions in step D(i), and wherein each of the five genomic control regions has a predictable copy number.

9. The method of claim 1, wherein the one or more genomic control regions are selected from the group consisting of ACTB, B2M, C1orf34, CHMP2A, GPI, GUSB, HMBS, HPRT1, PSMB4, RPL13A, RPLP0, SDHA, SNRPD3, UBC, VCP, VSP29, PPIA, PSMB2, RAB7A, REEP5, and EMC7, or wherein the one or more genomic control regions are PSMB2, RAB7A, PPIA, REEP5, and EMC7.

10. The method of claim 8, wherein amplification factors are determined for each of said five genomic control regions in step E.

11. The method of claim 10, wherein the total number of input genomes is calculated in step F by taking an average using each of the five amplification factors determined for each of said five genomic control regions.

12. The method of claim 1, wherein the amplification by multiplex PCR in steps A and D are done in a single multiplex reaction.

13. The method of claim 1, wherein the amplification by multiplex PCR in step A or step D is performed using a plurality of oligonucleotide primer sets comprising:

A) a plurality of V segment oligonucleotide primers that are each independently capable of specifically hybridizing to at least one polynucleotide encoding a TCR of Ig V region polypeptide or to the complement thereof, wherein each V segment primer comprises a nucleotide sequence of at least 15 contiguous nucleotides that is complementary to at least one functional a TCR or Ig V region encoding gene segment and wherein said plurality of V segment primers specifically hybridize to substantially all functional TCR or Ig V region encoding gene segments that are present in the composition, and B) a plurality of J segment oligonucleotide primers that are each independently capable of specifically hybridizing to at least one polynucleotide encoding an TCR or Ig J region polypeptide or to the complement thereof, wherein each J segment primer comprises a nucleotide sequence of at least 15 contiguous nucleotides that is complementary to at least one functional TCR or IG J region encoding gene segment and wherein said plurality of J segment primers specifically hybridize to substantially all functional TCR or IG J region encoding gene segments that are present in the composition.

14. The method of claim 13, wherein either or both of:
(i) said plurality of V segment oligonucleotide primers comprise sequences having at least 90% sequence identity to nucleotide sequences set forth in SEQ ID NOs: 1-120, 147-158, 167-276, 407-578, 593-740, and
(ii) said plurality of J segment oligonucleotide primers comprise sequences having at least 90% sequence identity to nucleotide sequences set forth in SEQ ID NOs: 121-146, 159-166, 277-406, 579-592, 741-764.

15. The method of claim 1, wherein said sample is fresh tissue, frozen tissue, or fixed tissue.

16. The method of claim 1, wherein said TCR V segment comprises a TCRG V segment, a TCRD V segment, a TCRA V segment, or a TCRB V segment.

17. The method of claim 1, wherein said TCR J segment comprises a TCRD J segment, a TCRG J segment, a TCRA J segment, or a TCRB J segment.

18. The method of claim 1, wherein said Ig V segment comprises an IGH V gene segment, an IGL V gene segment, or an IGK V gene segment.

19. The method of claim 1, wherein said Ig J region segment comprises an IGH J gene segment, an IGL J gene segment, or an IGK V gene segment.

20. The method of claim 1 wherein said output sequences obtained in step A(i), said synthetic templates contained in said first set of synthetic templates in step A(ii), said output sequences for each genomic control region in step D(i) and said synthetic templates contained in said second set of synthetic templates in step D(ii) are each about 100-300 nucleotides in length.

* * * * *